United States Patent 11,098,302 (IDENTIFICATION OF POLYNUCLEOTIDES ASSOCIATED WITH A SAMPLE) - sequence listing, part 148

SEQ ID NO: 571918 - DNA, 492 bp, Homo sapiens
  misc_feature: HIJSMM301CVQJX.52.82.H05.1.454.light.4.raw
cgcagtacgacacgaccggtgctcgatttagtcgagctctctcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcactc

SEQ ID NO: 571919 - DNA, 484 bp, Homo sapiens; identical to SEQ ID NO: 568521
  misc_feature: HIJSMM301BAOUT.40.15.B04.1.454.light.4.raw

SEQ ID NO: 571920 - DNA, 495 bp, Homo sapiens; identical to SEQ ID NO: 535712
  misc_feature: HIJSMM301BKP3S.27.78.H01.1.454.light.4.raw

SEQ ID NO: 571921 - DNA, 515 bp, Homo sapiens
  misc_feature: HIJSMM301EG0K2.49.37.D04.1.454.light.4.raw
agtcgagagacacgaccggtgctcgatttagtagcatactgttgggtttgggggctgtgggctcaggaggcagagctctgggaatctcaccatggcctggacccctctcctgctccccctcctcactttctgcacagtctctgaggcctcctatgagctgacacagtcaccctcgctgtcagtgtccccacggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagttttagggacagtggccaccctgacagtcagtggggcccaggtggaggatgagggtggattactactgttactcaacagacattactactactcatagggtgttcggcggagggaccaagctgaccgtcctaggtcagcccaaggctgccccctcggtcactctgttccccg

SEQ ID NO: 571922 - DNA, 486 bp, Homo sapiens; identical to SEQ ID NO: 535523
  misc_feature: HIJSMM301EXHMY.22.73.G07.1.454.light.4.raw

SEQ ID NO: 571923 - DNA, 481 bp, Homo sapiens; identical to SEQ ID NO: 536255
  misc_feature: HIJSMM301AQN1P.10.53.E09.1.454.light.4.raw

SEQ ID NO: 571924 - DNA, 508 bp, Homo sapiens; identical to SEQ ID NO: 554667
  misc_feature: HIJSMM301AROEN.2.21.B10.1.454.light.4.raw

SEQ ID NO: 571925 - DNA, 531 bp, Homo sapiens
  misc_feature: HIJSMM301C6Y2B.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccacgggaccgaccaacgtagaaaagtagaggaacgaacgtacgtaggcgtgcgacccactcctcgttcttctacttcttccccgtcccc

SEQ ID NO: 571926 - DNA, 501 bp, Homo sapiens
  misc_feature: HIJSMM301A1CKJ.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccccta

SEQ ID NO: 571927 - DNA, 513 bp, Homo sapiens
  misc_feature: HIJSMM301CNJ25.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccgaaggttgaccgtcctaggtcaacgcccaaggctgccccctcggtcactctgtt

SEQ ID NO: 571928 - DNA, 479 bp, Homo sapiens; identical to SEQ ID NO: 535188
  misc_feature: HIJSMM301AX7BY.10.74.G08.1.454.light.4.raw

SEQ ID NO: 571929 - DNA, 511 bp, Homo sapiens; identical to SEQ ID NO: 537464
  misc_feature: HIJSMM301EIIME.7.34.D01.1.454.light.4.raw

SEQ ID NO: 571930 - DNA, 496 bp, Homo sapiens; identical to SEQ ID NO: 537513
  misc_feature: HIJSMM301DUBMM.12.87.H10.1.454.light.4.raw

SEQ ID NO: 571931 - DNA, 494 bp, Homo sapiens; identical to SEQ ID NO: 535497
  misc_feature: HIJSMM301EOXH3.43.72.G06.1.454.light.4.raw

SEQ ID NO: 571932 - DNA, 486 bp, Homo sapiens; identical to SEQ ID NO: 535385
  misc_feature: HIJSMM301DAVRP.19.71.G05.1.454.light.4.raw

SEQ ID NO: 571933 - DNA, 512 bp, Homo sapiens
  misc_feature: HIJSMM301EY1EP.43.19.B08.1.454.light.4.raw
tgtgagtagtcacgaccggtgctcgatttagtgagtcagtaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtctaagtcagcccaaggctgccccctcggtcactctgttcccaccctcct

SEQ ID NO: 571934 - DNA, 509 bp, Homo sapiens
  misc_feature: HIJSMM301AL0OH.49.87.H10.1.454.light.4.raw
agtcgagagacacgaccggtgctcgatttagcagtactgcgttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggcggcgggaccaggctgaccgtcctgggtcagcccaaggctgccccctcggtcactctgttcccgt

SEQ ID NO: 571935 - DNA, 511 bp, Homo sapiens; identical to SEQ ID NO: 568890
  misc_feature: HIJSMM301BLB7O.8.33.C11.1.454.light.4.raw

SEQ ID NO: 571936 - DNA, 497 bp, Homo sapiens
  misc_feature: HIJSMM301CRYXI.40.54.E10.1.454.light.4.raw
  modified_base (486)..(486): a, c, t, g, unknown or other
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggagggaccaagctgaccgtcctaggtcagcccaaggcnccgcccgtcgt

SEQ ID NO: 571937 - DNA, 514 bp, Homo sapiens
  misc_feature: HIJSMM301EKQV9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtcgtgggacagatttcactctcaccatcagcagcctgcaggctgaagatgtggctagttttattactgtcaactagttttctcgggcgttcggccgaagggaccgaaggtaggaaatacaaaacgaactagtggctgcaccatctgtcttctactcttccccg

SEQ ID NO: 571938 - DNA, 490 bp, Homo sapiens; identical to SEQ ID NO: 543909
  misc_feature: HIJSMM301EF09S.14.55.E11.1.454.light.4.raw

SEQ ID NO: 571939 - DNA, 486 bp, Homo sapiens; identical to SEQ ID NO: 535043
  misc_feature: HIJSMM301DSGJY.46.35.D02.1.454.light.4.raw

SEQ ID NO: 571940 - DNA, 504 bp, Homo sapiens; identical to SEQ ID NO: 538423
  misc_feature: HIJSMM301AL89F.48.67.G01.1.454.light.4.raw

SEQ ID NO: 571941 - DNA, 485 bp, Homo sapiens
  misc_feature: HIJSMM301AEYPB.26.78.H01.1.454.light.4.raw
agactatactcacgaccggtgctcgatttagtgtgagtagtttgggtttggggcagagccctagggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggtagggaccgagggtggagatcagacgaa

SEQ ID NO: 571942 - DNA, 490 bp, Homo sapiens
  misc_feature: HIJSMM301A8VD3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggcggagggaccgaaggacggagatcagacgaactgtggctgcaccatctgtcttcta

SEQ ID NO: 571943 - DNA, 508 bp, Homo sapiens
  misc_feature: HIJSMM301DC2F3.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgtttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatcaaacgaaactgtggctgcaccatctgtctt

SEQ ID NO: 571944 - DNA, 487 bp, Homo sapiens; identical to SEQ ID NO: 540841
  misc_feature: HIJSMM301AZVRS.4.33.C11.1.454.light.4.raw

SEQ ID NO: 571945 - DNA, 494 bp, Homo sapiens
  misc_feature: HIJSMM301BZ9NE.43.79.H02.1.454.light.4.raw
tgtgagtagtcacgaccggtgctcgatttagtgtcacacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccgaggtggagatcaaacgaactagtggctgcaccatctgtcttcta

SEQ ID NO: 571946 - DNA, 491 bp, Homo sapiens; identical to SEQ ID NO: 537135
  misc_feature: HIJSMM301AXGPK.21.46.E02.1.454.light.4.raw

SEQ ID NO: 571947 - DNA, 494 bp, Homo sapiens
  misc_feature: HIJSMM301DGDPC.16.70.G04.1.454.light.4.raw
tgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtatcccagccaggttcagtggcagtgggtctgggacagagttcactctcaccatcagcagcctgcagtctgaagattttgcagtttattactgtcagcaatataatgactggcctccgctcactttcggcggagggaccaaggtggagatcaaacgaactgtggctgcaccatctgtcttc

SEQ ID NO: 571948 - DNA, 497 bp, Homo sapiens; identical to SEQ ID NO: 535740
  misc_feature: HIJSMM301B5XQB.3.71.G05.1.454.light.4.raw

SEQ ID NO: 571949 - DNA, 498 bp, Homo sapiens
  misc_feature: HIJSMM301BU8CQ.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagccttgtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaattatttttctatcctcgtggacgttcgccaaggaccaggtggaaatcagacgactgtggctgcaccat

SEQ ID NO: 571950 - DNA, 441 bp, Homo sapiens; identical to SEQ ID NO: 534971
  misc_feature: HIJSMM301CHKDY.11.3.A03.1.454.light.4.raw

SEQ ID NO: 571951 - DNA, 506 bp, Homo sapiens; identical to SEQ ID NO: 534969
  misc_feature: HIJSMM301EQJ3R.18.37.D04.1.454.light.4.raw

SEQ ID NO: 571952 - DNA, 511 bp, Homo sapiens
  misc_feature: HIJSMM301D3QQZ.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccacactgaccgtcctaggtcagccaaggctgccccctcggtcactctgtt

SEQ ID NO: 571953 - DNA, 472 bp, Homo sapiens
  misc_feature: HIJSMM301CDAKI.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctctccgagtgccacttttggcggggggtaccaaggtggacatcaaacgaa

SEQ ID NO: 571954 - DNA, 499 bp, Homo sapiens
  misc_feature: HIJSMM301D8GEL.4.71.G05.1.454.light.4.raw
  modified_base (417)..(417): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaataganaacagtgataatttctgggtgttcggcggagggaccaaactgaccgtcctaggtcagcccaaggctgccccctcggtcactc

SEQ ID NO: 571955 - DNA, 447 bp, Homo sapiens; identical to SEQ ID NO: 535020
  misc_feature: HIJSMM301AT5MK.18.9.A09.1.454.light.4.raw

SEQ ID NO: 571956 - DNA, 475 bp, Homo sapiens; identical to SEQ ID NO: 537714
  misc_feature: HIJSMM301AYA1O.7.81.H04.1.454.light.4.raw

SEQ ID NO: 571957 - DNA, 497 bp, Homo sapiens
  misc_feature: HIJSMM301CTS3O.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccaagggaccaaggtggaaatcaaacgaactgtggctgcacca

SEQ ID NO: 571958 - DNA, 503 bp, Homo sapiens
  misc_feature: HIJSMM301DPO25.2.76.G10.1.454.light.4.raw
  modified_base (462)..(462): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggacctgggaccaaggtcaccgtccttggt

SEQ ID NO: 571959 - DNA, 525 bp, Homo sapiens
  misc_feature: HIJSMM301DWGB4.17.75.G09.1.454.light.4.raw
cgtagactagcacgaccggtgctcgatttagtatagacatcaggggtctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcggggcaagctgccctgaccctaacgggggcgcagcctgaggacgaggccgactattattgcctactatcatttgatggtggtcgtctgcccattttcggcggcgggaccagggtggccgtcctgggtcagcccaaggctgccccctcggtcactctgttctcaccctcctcctagtctacg

SEQ ID NO: 571960 - DNA, 506 bp, Homo sapiens
  misc_feature: HIJSMM301EGPPF.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaaccacacacggccgctcactttcggcggagggaccaaggtggagatcaaacgaactgtggctgcaccatctgtt

SEQ ID NO: 571961 - DNA, 489 bp, Homo sapiens; identical to SEQ ID NO: 536663
  misc_feature: HIJSMM301C63TU.16.72.G06.1.454.light.4.raw

SEQ ID NO: 571962 - DNA, 517 bp, Homo sapiens
  misc_feature: HIJSMM301CFJC0.40.87.H10.1.454.light.4.raw
tctagcgactcacgaccggtgctcgatttagcagtactgcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgacgtcctaggtcagcccaaggctgccccctcggtcactcc

SEQ ID NO: 571963 - DNA, 447 bp, Homo sapiens; identical to SEQ ID NO: 535882
  misc_feature: HIJSMM301BQJ4E.18.9.A09.1.454.light.4.raw
  modified_base (429)..(429): a, c, t, g, unknown or other

SEQ ID NO: 571964 - DNA, 488 bp, Homo sapiens
  misc_feature: HIJSMM301AENKV.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggtcggagggaccgaacggtagggagagtcgaacgaactagtggcgtcg

SEQ ID NO: 571965 - DNA, 491 bp, Homo sapiens
  misc_feature: HIJSMM301ATEM6.12.1.A01.1.454.light.4.raw
  modified_base (481)..(481): a, c, t, g, unknown or other
atacgacgtacacgaccggtgctcgatttagacgtctcatcaaggaagggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagacgttaccgcgctcccatcactttcggccaagggacacgaccgcagattggacgaactgngctgcaccat

SEQ ID NO: 571966 - DNA, 510 bp, Homo sapiens
  misc_feature: HIJSMM301EWMJ4.16.83.H06.1.454.light.4.raw
tgtactactccacgaccggtgctcgatttagatcacgtgcgtcgcggagagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccta

SEQ ID NO: 571967 - DNA, 454 bp, Homo sapiens; identical to SEQ ID NO: 535005
  misc_feature: HIJSMM301DG9CV.19.86.H09.1.454.light.4.raw

SEQ ID NO: 571968 - DNA, 304 bp, Homo sapiens
  misc_feature: HIJSMM301DV37P.49.53.E09.1.454.light.4.raw
agtcgagagacacgaccggtgctcgatttagagagagtgtgttgggtttgggctgatagttgggtttgggaggagagacccctcccctgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccaccctcctctctctcgact

SEQ ID NO: 571969 - DNA, 492 bp, Homo sapiens
  misc_feature: HIJSMM301BXE08.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgctagtttattactgtcagcagtataatgactggcctccgacgttcggccaaggaccgaaggtaggaaatacaaacgaactgtggcgtgcaccat

SEQ ID NO: 571970 - DNA, 487 bp, Homo sapiens; identical to SEQ ID NO: 535863
  misc_feature: HIJSMM301AYM0H.19.71.G05.1.454.light.4.raw

SEQ ID NO: 571971 - DNA, 507 bp, Homo sapiens
  misc_feature: HIJSMM301ARA7I.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactttggctgcaccatctgtcttcatcttcccgccat

SEQ ID NO: 571972 - DNA, 508 bp, Homo sapiens
  misc_feature: HIJSMM301EQZBM.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcact

SEQ ID NO: 571973 - DNA, 493 bp, Homo sapiens
  misc_feature: HIJSMM301B153P.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagttattactgtcagcaatattatagtactcctccgaggctcactttcggcggagggaccaaggtggagatcaaacgaact

SEQ ID NO: 571974 - DNA, 495 bp, Homo sapiens
  misc_feature: HIJSMM301C93W8.10.79.H02.1.454.light.4.raw
catagtagtgcacgaccggtgctcgatttagtgtcacacgaaggggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaacctggccaggctcccgggctcctcatctatggtacatctagcagggccactggcatcccagacaggttcagtggcagtgggtctgggacagacttcactctcaccatcagcagactggagtctgagattttgcagtgtattattgtcagcaatatggtaggtcacctgggacttttggccaggggaccaagctggagatacaaacgaactgtggctgcaccatctgtcttcta

SEQ ID NO: 571975 - DNA, 486 bp, Homo sapiens; identical to SEQ ID NO: 535523
  misc_feature: HIJSMM301DQW25.22.73.G07.1.454.light.4.raw

SEQ ID NO: 571976 - DNA, 486 bp, Homo sapiens; identical to SEQ ID NO: 536261
  misc_feature: HIJSMM301DWBU0.26.55.E11.1.454.light.4.raw

SEQ ID NO: 571977 - DNA, 510 bp, Homo sapiens
  misc_feature: HIJSMM301DCXB6.17.2.A02.1.454.light.4.raw
  modified_base (438)..(438): a, c, t, g, unknown or other
  modified_base (507)..(507): a, c, t, g, unknown or other
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcaggggtccctgaccgattcgctggctccaactctggcacctcagccctccctggccatcagtgggctccagtctgaggatgaggctgattattactgtgcagcatgggatgccagcctgagtagtcccgtnttcggaactgggaccaaggtcaccgtcctacgtcagcccaaggcccaacccactgtcactctgttcccncct

SEQ ID NO: 571978 - DNA, 489 bp, Homo sapiens; identical to SEQ ID NO: 535139
  misc_feature: HIJSMM301BNJED.14.55.E11.1.454.light.4.raw

SEQ ID NO: 571979 - DNA, 494 bp, Homo sapiens
  misc_feature: HIJSMM301E3396.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccagggacccaggtggagatcagacgaaactgtggctgcaccatctgtcttcatcttcccg

SEQ ID NO: 571980 - DNA, 478 bp, Homo sapiens
  misc_feature: HIJSMM301EGFJM.40.23.C01.1.454.light.4.raw
tctagcgactcacgaccggtgctcgatttagtacacgtgattagggattggggggccgtcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggccaagctgaccgtcctaagtcagcccaagg

SEQ ID NO: 571981 - DNA, 501 bp, Homo sapiens; identical to SEQ ID NO: 536867
  misc_feature: HIJSMM301CMLIQ.5.86.H09.1.454.light.4.raw

SEQ ID NO: 571982 - DNA, 518 bp, Homo sapiens; identical to SEQ ID NO: 544387
  misc_feature: HIJSMM301BC3IM.19.80.H03.1.454.light.4.raw

SEQ ID NO: 571983 - DNA, 463 bp, Homo sapiens; identical to SEQ ID NO: 535062
  misc_feature: HIJSMM301ASYCM.11.73.G07.1.454.light.4.raw

SEQ ID NO: 571984 - DNA, 498 bp, Homo sapiens
  misc_feature: HIJSMM301CNALN.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactgggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaacccgttactttcggcggagggaccaaggtggagatcaaacgaactagtggctgcaccatctgtcttcatcttccccg

SEQ ID NO: 571985 - DNA, 484 bp, Homo sapiens
  misc_feature: HIJSMM301C97HD.52.23.C01.1.454.light.4.raw
cgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagacgaactgtggctgcaccat

SEQ ID NO: 571986 - DNA, 487 bp, Homo sapiens; identical to SEQ ID NO: 537573
  misc_feature: HIJSMM301D7F0M.3.10.A10.1.454.light.4.raw

SEQ ID NO: 571987 - DNA, 455 bp, Homo sapiens
  misc_feature: HIJSMM301EVWRZ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccaccgagagta

SEQ ID NO: 571988 - DNA, 502 bp, Homo sapiens; identical to SEQ ID NO: 536253
  misc_feature: HIJSMM301ADUX0.21.22.B11.1.454.light.4.raw

SEQ ID NO: 571989 - DNA, 495 bp, Homo sapiens; identical to SEQ ID NO: 535007
  misc_feature: HIJSMM301ELYO1.22.5.A05.1.454.light.4.raw

SEQ ID NO: 571990 - DNA, 513 bp, Homo sapiens; identical to SEQ ID NO: 535719
  misc_feature: HIJSMM301BMZ04.17.33.C11.1.454.light.4.raw

SEQ ID NO: 571991 - DNA, 503 bp, Homo sapiens; identical to SEQ ID NO: 536834
  misc_feature: HIJSMM301DVHDE.2.35.D02.1.454.light.4.raw

SEQ ID NO: 571992 - DNA, 510 bp, Homo sapiens; identical to SEQ ID NO: 565890
  misc_feature: HIJSMM301BJ3AI.15.34.D01.1.454.light.4.raw

SEQ ID NO: 571993 - DNA, 506 bp, Homo sapiens
  misc_feature: HIJSMM301DXNS6.5.60.F05.1.454.light.4.raw
atcagacacgcacgaccggtgctcgatttagtacgtcatcagggaaagggtagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggccaagctgaccgtcctcgtcagcccaaggctgccccctc

SEQ ID NO: 571994 - DNA, 478 bp, Homo sapiens; identical to SEQ ID NO: 541928
  misc_feature: HIJSMM301BKBNK.7.76.G10.1.454.light.4.raw

SEQ ID NO: 571995 - DNA, 495 bp, Homo sapiens; identical to SEQ ID NO: 535007
  misc_feature: HIJSMM301CJC3B.22.5.A05.1.454.light.4.raw

SEQ ID NO: 571996 - DNA, 384 bp, Homo sapiens
  misc_feature: HIJSMM301A6LGO.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaaacgaactgtggctgcaccatctgtcttcatcttcccgccatctgaatagtataga

SEQ ID NO: 571997 - DNA, 508 bp, Homo sapiens
  misc_feature: HIJSMM301DPE4S.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccgccctccc

SEQ ID NO: 571998 - DNA, 480 bp, Homo sapiens; identical to SEQ ID NO: 535975
  misc_feature: HIJSMM301AVEIF.51.60.F05.1.454.light.4.raw

SEQ ID NO: 571999 - DNA, 489 bp, Homo sapiens; identical to SEQ ID NO: 538992
  misc_feature: HIJSMM301DFIU0.21.65.F10.1.454.light.4.raw

SEQ ID NO: 572000 - DNA, 509 bp, Homo sapiens; identical to SEQ ID NO: 547321
  misc_feature: HIJSMM301CR2VY.4.57.F02.1.454.light.4.raw

SEQ ID NO: 572001 - DNA, 479 bp, Homo sapiens
  misc_feature: HIJSMM301AN89P.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtattggctgttcggcggcgggacc

SEQ ID NO: 572002 - DNA, 494 bp, Homo sapiens; identical to SEQ ID NO: 535680
  misc_feature: HIJSMM301DVSA1.16.78.H01.1.454.light.4.raw

SEQ ID NO: 572003 - DNA, 506 bp, Homo sapiens; identical to SEQ ID NO: 563474
  misc_feature: HIJSMM301AHR4L.10.27.C05.1.454.light.4.raw

SEQ ID NO: 572004 - DNA, 493 bp, Homo sapiens
  misc_feature: HIJSMM301D2EVW.48.23.C01.1.454.light.4.raw
agtatacatacacgaccggtgctcgatttagtacacgtgattagggattgggggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaccgaactgtggctgcaccatctgtcttcatcttcccgccatctgatatgtata

SEQ ID NO: 572005 - DNA, 503 bp, Homo sapiens
  misc_feature: HIJSMM301EWY66.49.30.C08.1.454.light.4.raw
  modified_base (493)..(493): a, c, t, g, unknown or other
agtcgagagacacgaccggtgctcgatttagtctgacgtcaaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctggaccagagtggatatcaaacgaactgtggctgcaccatctgtcttctancttcccgccc

SEQ ID NO: 572006 - DNA, 496 bp, Homo sapiens
  misc_feature: HIJSMM301AXEV5.12.27.C05.1.454.light.4.raw
atacgacgtacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacggccaacatcacctgctctggagataaattggggcataaatatgtctgctggtatcaacagaaggcaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgt

SEQ ID NO: 572007 - DNA, 508 bp, Homo sapiens; identical to SEQ ID NO: 541908
  misc_feature: HIJSMM301CZRNH.47.85.H08.1.454.light.4.raw

SEQ ID NO: 572008 - DNA, 499 bp, Homo sapiens
  misc_feature: HIJSMM301EEF2G.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttggccaggggaccaagctggagatcaaacgaactgtggctgcacc

SEQ ID NO: 572009 - DNA, 447 bp, Homo sapiens; identical to SEQ ID NO: 535201
  misc_feature: HIJSMM301CRGKO.18.9.A09.1.454.light.4.raw

SEQ ID NO: 572010 - DNA, 454 bp, Homo sapiens; identical to SEQ ID NO: 535005
  misc_feature: HIJSMM301AF0QZ.19.86.H09.1.454.light.4.raw

SEQ ID NO: 572011 - DNA, 494 bp, Homo sapiens
  misc_feature: HIJSMM301EUUHU.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagccttggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 572012 - DNA, 504 bp, Homo sapiens
  misc_feature: HIJSMM301DEHPI.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcaagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagattaaaacg

SEQ ID NO: 572013 - DNA, 496 bp, Homo sapiens
  misc_feature: HIJSMM301A5CF9.4.72.G06.1.454.light.4.raw
agcactgtagcacgaccggtgctcgatttagctacgactgcaagggaaagggggagggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggccaagggaccaacggtggaagtacaaacgaactagtaggctgcaccactctcg

SEQ ID NO: 572014 - DNA, 521 bp, Homo sapiens; identical to SEQ ID NO: 540400
  misc_feature: HIJSMM301A6A5G.27.23.C01.1.454.light.4.raw

SEQ ID NO: 572015 - DNA, 489 bp, Homo sapiens; identical to SEQ ID NO: 535139
  misc_feature: HIJSMM301DHPS1.14.55.E11.1.454.light.4.raw

SEQ ID NO: 572016 - DNA, 488 bp, Homo sapiens; identical to SEQ ID NO: 540827
  misc_feature: HIJSMM301DF9E5.15.49.E05.1.454.light.4.raw

SEQ ID NO: 572017 - DNA, 487 bp, Homo sapiens; identical to SEQ ID NO: 539157
  misc_feature: HIJSMM301A6CHM.26.37.D04.1.454.light.4.raw

SEQ ID NO: 572018 - DNA, 499 bp, Homo sapiens
  misc_feature: HIJSMM301DY4B6.2.76.G10.1.454.light.4.raw
  modified_base (462)..(462): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggacctgggaccaaggtcaccgtctt

SEQ ID NO: 572019 - DNA, 510 bp, Homo sapiens
  misc_feature: HIJSMM301BUKMJ.43.15.B04.1.454.light.4.raw
tgtgagtagtcacgaccggtgctcgatttagacagtatatatccgcgggcacgaccggtgctcgatttagacagtatatatccgcggggggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaaggggactttcggccaagggaccaaggtggaattcaaccgaa

SEQ ID NO: 572020 - DNA, 489 bp, Homo sapiens
  misc_feature: HIJSMM301DZZAS.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcaccatct

SEQ ID NO: 572021 - DNA, 489 bp, Homo sapiens
  misc_feature: HIJSMM301B9WLC.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccactttggtccaagggaccaagctggagatcaaacgaactgtggctgcacta

SEQ ID NO: 572022 - DNA, 490 bp, Homo sapiens
  misc_feature: HIJSMM301CEWIL.14.55.E11.1.454.light.4.raw
  modified_base (428)..(428): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatcccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggagggaccaaggcggagatcagacgaactgtggctgacaccatctgtcttca

SEQ ID NO: 572023 - DNA, 490 bp, Homo sapiens; identical to SEQ ID NO: 543909
  misc_feature: HIJSMM301C6VC6.14.55.E11.1.454.light.4.raw

SEQ ID NO: 572024 - DNA, 487 bp, Homo sapiens
  misc_feature: HIJSMM301BS1SX.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattaattatacttcgtggacgttcggccaagggaccaaggtggatatcagacgaa

SEQ ID NO: 572025 - DNA, 485 bp, Homo sapiens
  misc_feature: HIJSMM301CMQXI.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttgccagggacaaactggacatcaaacgaactgtggctgcaccatctgtt

SEQ ID NO: 572026 - DNA, 503 bp, Homo sapiens
  misc_feature: HIJSMM301A687Y.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactggagattaaaacg

SEQ ID NO: 572027 - DNA, 489 bp, Homo sapiens; identical to SEQ ID NO: 536663
  misc_feature: HIJSMM301DMRS1.16.72.G06.1.454.light.4.raw

SEQ ID NO: 572028 - DNA, 448 bp, Homo sapiens
  misc_feature: HIJSMM301DBRYB.18.9.A09.1.454.light.4.raw
tacgagtatgcacgaccggtgctcgatttagcgagacgcgcaggggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 572029 - DNA, 484 bp, Homo sapiens; identical to SEQ ID NO: 535240
  misc_feature: HIJSMM301DAZIV.47.60.F05.1.454.light.4.raw

SEQ ID NO: 572030 - DNA, 518 bp, Homo sapiens; identical to SEQ ID NO: 561292
  misc_feature: HIJSMM301EV5H9.22.30.C08.1.454.light.4.raw
  modified_base (507)..(507): a, c, t, g, unknown or other

SEQ ID NO: 572031 - DNA, 497 bp, Homo sapiens
  misc_feature: HIJSMM301DW7G2.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggtttcggcggagggactaagctgaccgtctaagtcagcccaa

SEQ ID NO: 572032 - DNA, 498 bp, Homo sapiens
  misc_feature: HIJSMM301BF75P.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactagtggctgcaccatctgtcttcattcc

SEQ ID NO: 572033 - DNA, 512 bp, Homo sapiens
  misc_feature: HIJSMM301CFJ2J.15.59.F04.1.454.light.4.raw
tctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtccta

SEQ ID NO: 572034 - DNA, 444 bp, Homo sapiens; identical to SEQ ID NO: 535027
  misc_feature: HIJSMM301CAB58.8.73.G07.1.454.light.4.raw

SEQ ID NO: 572035 - DNA, 479 bp, Homo sapiens; identical to SEQ ID NO: 542895
  misc_feature: HIJSMM301DZBME.40.59.F04.1.454.light.4.raw

SEQ ID NO: 572036 - DNA, 505 bp, Homo sapiens; identical to SEQ ID NO: 536254
  misc_feature: HIJSMM301C1MSU.7.71.G05.1.454.light.4.raw

SEQ ID NO: 572037 - DNA, 480 bp, Homo sapiens; identical to SEQ ID NO: 542764
  misc_feature: HIJSMM301BHSVP.48.26.C04.1.454.light.4.raw

SEQ ID NO: 572038 - DNA, 486 bp, Homo sapiens; identical to SEQ ID NO: 535043
  misc_feature: HIJSMM301ET13D.46.35.D02.1.454.light.4.raw

SEQ ID NO: 572039 - DNA, 513 bp, Homo sapiens
  misc_feature: HIJSMM301A4L9Q.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaggcatccaccagggccactggccgtcccagccaggttcgatggcagtgggtctgggacagacttcactctcaccatcagcagcctggagcctgaagatattgctagtttattattgtcagcagcgtagcgaggtggcctttcacgtttccggcccggggaaccaaggtaggaaatacaaacgaactgtggctgcaccatctgtctcatcttcccgc

SEQ ID NO: 572040 - DNA, 477 bp, Homo sapiens; identical to SEQ ID NO: 538761
  misc_feature: HIJSMM301EBEU6.7.76.G10.1.454.light.4.raw

SEQ ID NO: 572041 - DNA, 464 bp, Homo sapiens; identical to SEQ ID NO: 536640
  misc_feature: HIJSMM301CNRXM.26.78.H01.1.454.light.4.raw

SEQ ID NO: 572042 - DNA, 503 bp, Homo sapiens; identical to SEQ ID NO: 536760
  misc_feature: HIJSMM301DKNJO.47.55.E11.1.454.light.4.raw

SEQ ID NO: 572043 - DNA, 509 bp, Homo sapiens; identical to SEQ ID NO: 539269
  misc_feature: HIJSMM301B6VP5.4.57.F02.1.454.light.4.raw

SEQ ID NO: 572044 - DNA, 444 bp, Homo sapiens; identical to SEQ ID NO: 535042
  misc_feature: HIJSMM301EATO0.10.76.G10.1.454.light.4.raw

SEQ ID NO: 572045 - DNA, 491 bp, Homo sapiens; identical to SEQ ID NO: 535294
  misc_feature: HIJSMM301BF61X.16.68.G02.1.454.light.4.raw

SEQ ID NO: 572046 - DNA, 494 bp, Homo sapiens; identical to SEQ ID NO: 534992
  misc_feature: HIJSMM301D7EYC.9.1.A01.1.454.light.4.raw

SEQ ID NO: 572047 - DNA, 501 bp, Homo sapiens; identical to SEQ ID NO: 549899
  misc_feature: HIJSMM301BB2GP.41.18.B07.1.454.light.4.raw

SEQ ID NO: 572048 - DNA, 447 bp, Homo sapiens; identical to SEQ ID NO: 535020
  misc_feature: HIJSMM301AMG1P.18.9.A09.1.454.light.4.raw

SEQ ID NO: 572049 - DNA, 520 bp, Homo sapiens
  misc_feature: HIJSMM301DBGR5.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgttcccgccct

SEQ ID NO: 572050 - DNA, 485 bp, Homo sapiens; identical to SEQ ID NO: 540113
  misc_feature: HIJSMM301EA8HJ.17.34.D01.1.454.light.4.raw

SEQ ID NO: 572051 - DNA, 511 bp, Homo sapiens
  misc_feature: HIJSMM301EN1TW.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttatactgtcagcactgttttggcggttctccgactttcgtcggagggaccgaaggtggaggtcgaaacgaaacctagtggcgtgcgaccatctgtcttcta

SEQ ID NO: 572052 - DNA, 498 bp, Homo sapiens
  misc_feature: HIJSMM301DKXUO.5.48.E04.1.454.light.4.raw
atcagacacgcacgaccggtgctcgatttagagagcgtcacagagagaagggggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggacgcctagaagtctttgtgctgttatttctgtcagcagtattgtttcgctacctttctacgtttcggcggtacggaccaagggtggagagcagacgaactgtggctgcacat

SEQ ID NO: 572053 - DNA, 486 bp, Homo sapiens; identical to SEQ ID NO: 535917
  misc_feature: HIJSMM301DQS44.3.10.A10.1.454.light.4.raw

SEQ ID NO: 572054 - DNA, 495 bp, Homo sapiens; identical to SEQ ID NO: 563606
  misc_feature: HIJSMM301A1K86.5.12.B01.1.454.light.4.raw

SEQ ID NO: 572055 - DNA, 513 bp, Homo sapiens
  misc_feature: HIJSMM301AYX44.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtgggaaataaaacgaactagtggctgcaccatcctgtcttcatt

SEQ ID NO: 572056 - DNA, 497 bp, Homo sapiens
  misc_feature: HIJSMM301DHDDA.43.34.D01.1.454.light.4.raw
tgtgagtagtcacgaccggtgctcgatttagatcgtctgtgttgagtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtctttcggaattgggacgacggtcaccgtcctaggtcagcccaaggccaacccactgtcactctgttcccaccctcctcactactca

SEQ ID NO: 572057 - DNA, 495 bp, Homo sapiens
  misc_feature: HIJSMM301DQBMF.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggacacttttggccgggggtaccaagctggagatcaaacgaactgtggctgcaccatctgtcttcta

SEQ ID NO: 572058 - DNA, 486 bp, Homo sapiens; identical to SEQ ID NO: 535385
  misc_feature: HIJSMM301CT1IS.19.71.G05.1.454.light.4.raw

SEQ ID NO: 572059 - DNA, 502 bp, Homo sapiens; identical to SEQ ID NO: 535463
  misc_feature: HIJSMM301DJBNG.43.86.H09.1.454.light.4.raw

SEQ ID NO: 572060 - DNA, 507 bp, Homo sapiens
  misc_feature: HIJSMM301BS9XI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtaggaaatacaaaacgaactagtggctgcaccatctgtcttcatcttccccg

SEQ ID NO: 572061 - DNA, 507 bp, Homo sapiens
  misc_feature: HIJSMM301AUNQQ.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgctagtttattattgtcagcagtataataactggcctccgtggacgttcggccaagggaccaaggtaggaaatacaaacgaacctagtggcgtgcgaccatctgtcttcta

SEQ ID NO: 572062 - DNA, 509 bp, Homo sapiens; identical to SEQ ID NO: 543772
  misc_feature: HIJSMM301AS6DE.2.21.B10.1.454.light.4.raw

SEQ ID NO: 572063 - DNA, 492 bp, Homo sapiens; identical to SEQ ID NO: 544389
  misc_feature: HIJSMM301BOLWU.22.25.C03.1.454.light.4.raw

SEQ ID NO: 572064 - DNA, 460 bp, Homo sapiens; identical to SEQ ID NO: 545790
  misc_feature: HIJSMM301AU7ZI.22.28.C06.1.454.light.4.raw
  modified_base (442)..(442): a, c, t, g, unknown or other

SEQ ID NO: 572065 - DNA, 496 bp, Homo sapiens
  misc_feature: HIJSMM301AH8N4.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgttcggccaagggaccaaggtggacctcaacgaactgtggctgcaccat

SEQ ID NO: 572066 - DNA, 443 bp, Homo sapiens
  misc_feature: HIJSMM301BKASS.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccctcctcagacgtatca

SEQ ID NO: 572067 - DNA, 493 bp, Homo sapiens
  misc_feature: HIJSMM301DUVFW.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcaggacacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtctaggtcagcccaagg

SEQ ID NO: 572068 - DNA, 486 bp, Homo sapiens; identical to SEQ ID NO: 535043
  misc_feature: HIJSMM301AYZM8.46.35.D02.1.454.light.4.raw

SEQ ID NO: 572069 - DNA, 497 bp, Homo sapiens
  misc_feature: HIJSMM301DK4EZ.40.71.G05.1.454.light.4.raw
tctagcgactcacgaccggtgctcgatttagtgtcgtcgcaagagagagggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacacgcccccaaactcctctatttatgacaataataagcgaccctcagggattcctgaccgattctctggctccaagtctggcacgtcacgccaccctgggcatcaccggactccagactggcgacgaggccgtttattattgacggaacatgggatagcggcctgagtgatgagtggatggttcggcggcggacaaactgaccgtct

SEQ ID NO: 572070 - DNA, 506 bp, Homo sapiens
  misc_feature: HIJSMM301BHDMC.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagtcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 572071 - DNA, 487 bp, Homo sapiens; identical to SEQ ID NO: 535508
  misc_feature: HIJSMM301BNONI.13.87.H10.1.454.light.4.raw

SEQ ID NO: 572072 - DNA, 494 bp, Homo sapiens; identical to SEQ ID NO: 534994
  misc_feature: HIJSMM301CDSKD.27.78.H01.1.454.light.4.raw

SEQ ID NO: 572073 - DNA, 474 bp, Homo sapiens; identical to SEQ ID NO: 544751
  misc_feature: HIJSMM301A5L2S.3.38.D05.1.454.light.4.raw

SEQ ID NO: 572074 - DNA, 496 bp, Homo sapiens
  misc_feature: HIJSMM301ANCF1.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgctaccaaggtcaccgtcctgggtcagcccaaggccaaccccactgtcact

SEQ ID NO: 572075 - DNA, 517 bp, Homo sapiens
  misc_feature: HIJSMM301C67A1.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccgccctcct

SEQ ID NO: 572076 - DNA, 490 bp, Homo sapiens; identical to SEQ ID NO: 551555
  misc_feature: HIJSMM301B4KJ5.10.72.G06.1.454.light.4.raw

SEQ ID NO: 572077 - DNA, 520 bp, Homo sapiens; identical to SEQ ID NO: 539176
  misc_feature: HIJSMM301CLA32.27.23.C01.1.454.light.4.raw

SEQ ID NO: 572078 - DNA, 475 bp, Homo sapiens
  misc_feature: HIJSMM301BKIBB.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtcgcccccttcaccttcggccaagggacacgactggagattagaacg

SEQ ID NO: 572079 - DNA, 495 bp, Homo sapiens
  misc_feature: HIJSMM301BNP7N.9.71.G05.1.454.light.4.raw
tgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggtttcctctttcaagatattcggcggagggaccaggctgaccgtcctgagtcagcccaaggctg

SEQ ID NO: 572080 - DNA, 505 bp, Homo sapiens
  misc_feature: HIJSMM301EOZXE.48.71.G05.1.454.light.4.raw
agtatacatacacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgttcagcagtatggaagttcacctcggacattcggccaggggaccaaggtggaaatcaaacgaactgtggctgcaccatctgtcttcatcttcccg

SEQ ID NO: 572081 - DNA, 481 bp, Homo sapiens; identical to SEQ ID NO: 535993
  misc_feature: HIJSMM301EDGK8.21.25.C03.1.454.light.4.raw

SEQ ID NO: 572082 - DNA, 494 bp, Homo sapiens; identical to SEQ ID NO: 534994
  misc_feature: HIJSMM301E0V7P.27.78.H01.1.454.light.4.raw

SEQ ID NO: 572083 - DNA, 501 bp, Homo sapiens
  misc_feature: HIJSMM301E3JFM.52.25.C03.1.454.light.4.raw
cgcagtacgacacgaccggtgctcgatttagtagtgtagatttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaaagctgaccgtcctaggtcagcccaaggctgccccctccggtcact

SEQ ID NO: 572084 - DNA, 511 bp, Homo sapiens; identical to SEQ ID NO: 550438
  misc_feature: HIJSMM301EE4M6.17.33.C11.1.454.light.4.raw

SEQ ID NO: 572085 - DNA, 447 bp, Homo sapiens; identical to SEQ ID NO: 535020
  misc_feature: HIJSMM301CI330.18.9.A09.1.454.light.4.raw

SEQ ID NO: 572086 - DNA, 492 bp, Homo sapiens; identical to SEQ ID NO: 539815
  misc_feature: HIJSMM301BJQH3.51.81.H04.1.454.light.4.raw

SEQ ID NO: 572087 - DNA, 505 bp, Homo sapiens
  misc_feature: HIJSMM301CQNHF.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtcggaaatacaaacgaaactgtggctgcaccatctgtcttcatcttccccg

SEQ ID NO: 572088 - DNA, 498 bp, Homo sapiens
  misc_feature: HIJSMM301DJ23A.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaagtacaaacgaactagtggctgcaccatctgtcttcat

SEQ ID NO: 572089 - DNA, 487 bp, Homo sapiens
  misc_feature: HIJSMM301EX3AB.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaaacgaactgtggctgcaccat

SEQ ID NO: 572090 - DNA, 480 bp, Homo sapiens; identical to SEQ ID NO: 556526
  misc_feature: HIJSMM301A7BLW.11.76.G10.1.454.light.4.raw

SEQ ID NO: 572091 - DNA, 507 bp, Homo sapiens
  misc_feature: HIJSMM301DKBKT.5.60.F05.1.454.light.4.raw
  modified_base (427)..(427): a, c, t, g, unknown or other
atcagacacgcacgaccggtgctcgatttagtacgtcatcagggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctcctggccatccgtgggctccagtctgaggatgagtctgattattactgtgcaacntgggatgacagcctgaatggtccggtattcggcggagggaccaagctgaccgtcctcggtcagcccaaggctgccccctc

SEQ ID NO: 572092 - DNA, 499 bp, Homo sapiens
  misc_feature: HIJSMM301BO4XI.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccagggaccaagctggagatcaaacgaactgtggctgcaccatctgtcttcatt

SEQ ID NO: 572093 - DNA, 491 bp, Homo sapiens
  misc_feature: HIJSMM301ASXUM.48.72.G06.1.454.light.4.raw
agtatacatacacgaccggtgctcgatttagctacgactgcaagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtgg

SEQ ID NO: 572094 - DNA, 521 bp, Homo sapiens; identical to SEQ ID NO: 557835
  misc_feature: HIJSMM301CN6AV.27.23.C01.1.454.light.4.raw
  modified_base (510)..(510): a, c, t, g, unknown or other

SEQ ID NO: 572095 - DNA, 498 bp, Homo sapiens
  misc_feature: HIJSMM301EU40O.41.38.D05.1.454.light.4.raw
tctatactatcacgaccggtgctcgatttagtatctgatagttgggtttggggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcattcc

SEQ ID NO: 572096 - DNA, 497 bp, Homo sapiens
  misc_feature: HIJSMM301ANA0I.52.45.E01.1.454.light.4.raw
cgcagtacgacacgaccggtgctcgatttagtgagtcagtaagggaaagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttttgatgtacactggtaccagcagcttccgggaacagcccccaaactcctcatctttggtaacagcaatcggccctccggggtccctgaccgattctctggctccaagtctggcacctcagcctccctggccatcactgggctccaggctgaggatgaggctgattattactgccagtcctatgacagcagcctgagtgtcttttgggtcttcggaactgggaccaaggtcaccgtctaggtcacg

SEQ ID NO: 572097 - DNA, 486 bp, Homo sapiens; identical to SEQ ID NO: 535043
  misc_feature: HIJSMM301CHDDU.46.35.D02.1.454.light.4.raw

SEQ ID NO: 572098 - DNA, 519 bp, Homo sapiens
  misc_feature: HIJSMM301BXZ35.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttgaaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccacct

SEQ ID NO: 572099 - DNA, 492 bp, Homo sapiens
  misc_feature: HIJSMM301CUZN8.14.5.A05.1.454.light.4.raw
cgtctagtaccacgaccggtgctcgatttagatagatagacagggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccatctgtcttcta

SEQ ID NO: 572100 - DNA, 483 bp, Homo sapiens
  misc_feature: HIJSMM301CUTPY.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttatactgtcatcaatatggtgaccggcccacggttcggccaagggaccaaggtggaaatcaaacgaactgtggctgcaccatctgtctt

SEQ ID NO: 572101 - DNA, 503 bp, Homo sapiens
  misc_feature: HIJSMM301E2DKY.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 572102 - DNA, 488 bp, Homo sapiens; identical to SEQ ID NO: 535990
  misc_feature: HIJSMM301CKSCF.11.28.C06.1.454.light.4.raw

SEQ ID NO: 572103 - DNA, 496 bp, Homo sapiens
  misc_feature: HIJSMM301BOMSB.51.85.H08.1.454.light.4.raw
cgatcgtatacacgaccggtgctcgatttagtatcactcagtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcatt

SEQ ID NO: 572104 - DNA, 488 bp, Homo sapiens
  misc_feature: HIJSMM301ATFV8.49.59.F04.1.454.light.4.raw
agtcgagagacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccaggggaccaagctggagatcaaacgaactgtggctgcaccatctgt

SEQ ID NO: 572105 - DNA, 493 bp, Homo sapiens; identical to SEQ ID NO: 551374
  misc_feature: HIJSMM301CELO2.16.6.A06.1.454.light.4.raw

SEQ ID NO: 572106 - DNA, 486 bp, Homo sapiens; identical to SEQ ID NO: 535385
  misc_feature: HIJSMM301C797B.19.71.G05.1.454.light.4.raw

SEQ ID NO: 572107 - DNA, 504 bp, Homo sapiens
  misc_feature: HIJSMM301B9B0K.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggcagcccaaggcccaacccactgtca

SEQ ID NO: 572108 - DNA, 501 bp, Homo sapiens; identical to SEQ ID NO: 535746
  misc_feature: HIJSMM301ES7TR.18.11.A11.1.454.light.4.raw

SEQ ID NO: 572109 - DNA, 511 bp, Homo sapiens
  misc_feature: HIJSMM301B3KBV.47.55.E11.1.454.light.4.raw
agctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccccactgtcactctgttccca

SEQ ID NO: 572110 - DNA, 497 bp, Homo sapiens
  misc_feature: HIJSMM301C49GE.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattccctcctcagacgttcggccaagggaccaaggtggaaatcaaagaactgtggctgcacca

SEQ ID NO: 572111 - DNA, 506 bp, Homo sapiens; identical to SEQ ID NO: 537290
  misc_feature: HIJSMM301CE04M.13.11.A11.1.454.light.4.raw

SEQ ID NO: 572112 - DNA, 483 bp, Homo sapiens
  misc_feature: HIJSMM301C6LRT.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatggacaccggcctcagtgcgtgggttttcggcggagggaccaagctgaccgtcctaggtcagacccg

SEQ ID NO: 572113 - DNA, 495 bp, Homo sapiens
  misc_feature: HIJSMM301BXS7X.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaaactgtggctgcaccatctgtcttcatt

SEQ ID NO: 572114 - DNA, 485 bp, Homo sapiens; identical to SEQ ID NO: 547492
  misc_feature: HIJSMM301AJHTQ.10.28.C06.1.454.light.4.raw

SEQ ID NO: 572115 - DNA, 507 bp, Homo sapiens
  misc_feature: HIJSMM301DTS3D.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaactagtggctgcaccatctgtcttctactcttccccg

SEQ ID NO: 572116 - DNA, 493 bp, Homo sapiens; identical to SEQ ID NO: 536969
  misc_feature: HIJSMM301BAJO8.27.78.H01.1.454.light.4.raw

SEQ ID NO: 572117 - DNA, 381 bp, Homo sapiens
  misc_feature: HIJSMM301DW3WL.49.42.D09.1.454.light.4.raw
agtcgagagacacgaccggtgctcgatttagacacatacgcagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctaggtcagcccaaggccaaccccactgtcactctgttcccaccctcctctctctcgact

SEQ ID NO: 572118 - DNA, 483 bp, Homo sapiens; identical to SEQ ID NO: 544786
  misc_feature: HIJSMM301BO7VM.46.26.C04.1.454.light.4.raw

SEQ ID NO: 572119 - DNA, 488 bp, Homo sapiens
  misc_feature: HIJSMM301C3SKJ.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccaggtcaccgtcctaggtcagcccaaggccaacccc

SEQ ID NO: 572120 - DNA, 487 bp, Homo sapiens
  misc_feature: HIJSMM301DM4LK.15.1.A01.1.454.light.4.raw
tctacgtagccacgaccggtgctcgatttagacgtctcatcagggcctgggctctgctgcctcctcactctcctcactcaggacgacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtaga

SEQ ID NO: 572121 - DNA, 497 bp, Homo sapiens; identical to SEQ ID NO: 536376
  misc_feature: HIJSMM301AFTMA.22.9.A09.1.454.light.4.raw

SEQ ID NO: 572122 - DNA, 510 bp, Homo sapiens; identical to SEQ ID NO: 535474
  misc_feature: HIJSMM301ECYC5.17.33.C11.1.454.light.4.raw

SEQ ID NO: 572123 - DNA, 454 bp, Homo sapiens; identical to SEQ ID NO: 535005
  misc_feature: HIJSMM301BZWIW.19.86.H09.1.454.light.4.raw

SEQ ID NO: 572124 - DNA, 499 bp, Homo sapiens; identical to SEQ ID NO: 538904
  misc_feature: HIJSMM301BWL17.26.26.C04.1.454.light.4.raw

SEQ ID NO: 572125 - DNA, 509 bp, Homo sapiens
  misc_feature: HIJSMM301CJJP9.43.71.G05.1.454.light.4.raw
tgtgagtagtcacgaccggtgctcgatttagtgtcgtcgcaagagagaggggggaagagctgctcagttaggacccacgagggaaccgatggaaaccccacgcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagatttcactctcaccatcagcagtctacaacctgaagattttgcaacttactactgtcaacagagtttcagtacccctctgacgttcgccaagggaccaagtggaataaacgaactgtggctgcaccatctgtcttcatcttcccgccat

SEQ ID NO: 572126 - DNA, 460 bp, Homo sapiens; identical to SEQ ID NO: 536053
  misc_feature: HIJSMM301DXJUR.22.28.C06.1.454.light.4.raw

SEQ ID NO: 572127 - DNA, 444 bp, Homo sapiens; identical to SEQ ID NO: 560394
  misc_feature: HIJSMM301CQEW7.10.76.G10.1.454.light.4.raw
  modified_base (426)..(426): a, c, t, g, unknown or other

SEQ ID NO: 572128 - DNA, 499 bp, Homo sapiens
  misc_feature: HIJSMM301EMHB9.9.53.E09.1.454.light.4.raw
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggcc

SEQ ID NO: 572129 - DNA, 513 bp, Homo sapiens
  misc_feature: HIJSMM301B0O2E.43.5.A05.1.454.light.4.raw
tgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgcttcgggttttcggcggagggaccaagttgaccgtcctaggtcagcccaaggctgccccctcggtcactctgttcccgccctcctcta

SEQ ID NO: 572130 - DNA, 497 bp, Homo sapiens
  misc_feature: HIJSMM301EQPTU.17.53.E09.1.454.light.4.raw
cgtagactagcacgaccggtgctcgatttagagagagtgtgttgggtttgggggagctgctcagttaggacccagagggaaccatggaaaccccagcgcagcttctcttcctcctgctactctggctcccagatgtcaccggagaagttgtgttgacgcagtctccagccaccctgtctttgtctccaggggaaaagccaccctctcctgctgggccagccagtatgtcagcagtgataatttagcctggtatcagcaaaaacatggccaggctcccaggctcctcatctttggtgcatccagcaggatcactggcgtccctgacaggttcagaggcagggggtctgggacagacttcactctcaccatcaacagactggagcctgaagattttgcaatttattattgtcagcagtatggttcctcaccatctttcggcggagggaccaggggtggagatgaatacgaactggtggctgcaccattctgttcttcta

SEQ ID NO: 572131 - DNA, 490 bp, Homo sapiens
  misc_feature: HIJSMM301D13YO.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggttattactgcatgcaagctctacaaactccttacacttttggccagggaccaagctggagatcaaacgaactgtgg

SEQ ID NO: 572132 - DNA, 514 bp, Homo sapiens
  misc_feature: HIJSMM301AU115.43.59.F04.1.454.light.4.raw
tgtgagtagtcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgtt

SEQ ID NO: 572133 - DNA, 494 bp, Homo sapiens; identical to SEQ ID NO: 535680
  misc_feature: HIJSMM301A74X3.16.78.H01.1.454.light.4.raw

SEQ ID NO: 572134 - DNA, 481 bp, Homo sapiens; identical to SEQ ID NO: 541494
  misc_feature: HIJSMM301CMWVF.51.76.G10.1.454.light.4.raw

SEQ ID NO: 572135 - DNA, 479 bp, Homo sapiens; identical to SEQ ID NO: 536513
  misc_feature: HIJSMM301ENKSN.40.8.A08.1.454.light.4.raw

SEQ ID NO: 572136 - DNA, 495 bp, Homo sapiens
  misc_feature: HIJSMM301A530R.9.86.H09.1.454.light.4.raw
tgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctcgccccctcggtcactctcgttcccaccctcctcagacgtatca

SEQ ID NO: 572137 - DNA, 470 bp, Homo sapiens
  misc_feature: HIJSMM301BCN0A.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtctaggtcagccccg

SEQ ID NO: 572138 - DNA, 506 bp, Homo sapiens; identical to SEQ ID NO: 558980
  misc_feature: HIJSMM301CWDL5.19.78.H01.1.454.light.4.raw

SEQ ID NO: 572139 - DNA, 498 bp, Homo sapiens
  misc_feature: HIJSMM301CCNIF.11.75.G09.1.454.light.4.raw
  modified_base (478)..(478): a, c, t, g, unknown or other
cgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgcctccttggccatcactgggctcgaggctgacgatgaggctgattactactgtctgtcctatgacgacgaccctacagactccggttttcggcggagggactaagctnaccgtcctaagtcagcccaa

SEQ ID NO: 572140 - DNA, 487 bp, Homo sapiens; identical to SEQ ID NO: 540237
  misc_feature: HIJSMM301BAOSU.47.67.G01.1.454.light.4.raw

SEQ ID NO: 572141 - DNA, 507 bp, Homo sapiens; identical to SEQ ID NO: 559118
  misc_feature: HIJSMM301AOZGA.17.87.H10.1.454.light.4.raw

SEQ ID NO: 572142 - DNA, 513 bp, Homo sapiens; identical to SEQ ID NO: 565259
  misc_feature: HIJSMM301DXNZW.17.33.C11.1.454.light.4.raw

SEQ ID NO: 572143 - DNA, 492 bp, Homo sapiens; identical to SEQ ID NO: 536010
  misc_feature: HIJSMM301CZCIN.10.20.B09.1.454.light.4.raw

SEQ ID NO: 572144 - DNA, 504 bp, Homo sapiens
  misc_feature: HIJSMM301DRHSA.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactgtggctgcaccatctgtcttcactcttcccgcc

SEQ ID NO: 572145 - DNA, 418 bp, Homo sapiens
  misc_feature: HIJSMM301EI34T.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 572146 - DNA, 493 bp, Homo sapiens
  misc_feature: HIJSMM301A1NU9.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcatttccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcacgtcctaggtcagcccaaggccaaccccactgtcactctgtt

SEQ ID NO: 572147 - DNA, 491 bp, Homo sapiens; identical to SEQ ID NO: 540256
  misc_feature: HIJSMM301BCS70.46.67.G01.1.454.light.4.raw

SEQ ID NO: 572148 - DNA, 484 bp, Homo sapiens; identical to SEQ ID NO: 535441
  misc_feature: HIJSMM301BNE9Q.26.60.F05.1.454.light.4.raw

SEQ ID NO: 572149 - DNA, 472 bp, Homo sapiens; identical to SEQ ID NO: 536302
  misc_feature: HIJSMM301CQRBE.18.76.G10.1.454.light.4.raw

SEQ ID NO: 572150 - DNA, 514 bp, Homo sapiens
  misc_feature: HIJSMM301ET7R8.52.61.F06.1.454.light.4.raw
cgcagtacgacacgaccggtgctcgatttagctacgctctaagggaaagggctctcaggacgtcaccaccatggcctgggctctgctcctcctcaccctcctcactcagggcacagggtcctgggcccagtctgccctgactcagcctccctccgcgtccgggtctcgtggacagtcagtcaccatctcctgcactggatccttcagtgacattggcatttataactttgtctcctggtaccaacaacacccgggcaaagcccccaaactcatcatttttgaggtcactaagcggccctcagggtcccgtgatcgcttctctggctccaagtctggcaacacggcctccctgaccgtctctgggctccagtctgacgatgaggcggactatttctgcatctcatatgcaggcaccgataaattagtcttcggcggcgggaccaagctgaccgtcctaggtcagcccaaggctgccccctcggtcacctctgttcccaccctctctatacgatcg

SEQ ID NO: 572151 - DNA, 503 bp, Homo sapiens; identical to SEQ ID NO: 539976
  misc_feature: HIJSMM301A5CYN.47.55.E11.1.454.light.4.raw

SEQ ID NO: 572152 - DNA, 486 bp, Homo sapiens
  misc_feature: HIJSMM301BGIUP.3.55.E11.1.454.light.4.raw
  modified_base (474)..(474): a, c, t, g, unknown or other
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagatttgcaatttattactgtcagcagtataataactggtggacgttcggccaagggaccaaggtagaaatcaaacgaactgtggntgcacatctgtt

SEQ ID NO: 572153 - DNA, 492 bp, Homo sapiens
  misc_feature: HIJSMM301BGA5S.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccacggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccacggctacggatgaggctgactattactgtcaggcgtgggacagcagcacctatgtggttttcggtcggagggaccgaagctgaccgtccttggtcagcccaaggctgccccccg

SEQ ID NO: 572154 - DNA, 504 bp, Homo sapiens
  misc_feature: HIJSMM301CJE31.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaagggaccgaaggtaggaaagtacaaacgaactagtggctgcaccatctgtcttcatcttccccg

SEQ ID NO: 572155 - DNA, 455 bp, Homo sapiens; identical to SEQ ID NO: 571987
  misc_feature: HIJSMM301CDQCN.19.86.H09.1.454.light.4.raw

SEQ ID NO: 572156 - DNA, 494 bp, Homo sapiens; identical to SEQ ID NO: 535276
  misc_feature: HIJSMM301BI35C.16.6.A06.1.454.light.4.raw

SEQ ID NO: 572157 - DNA, 490 bp, Homo sapiens; identical to SEQ ID NO: 541141
  misc_feature: HIJSMM301BLNQG.47.38.D05.1.454.light.4.raw

SEQ ID NO: 572158 - DNA, 520 bp, Homo sapiens
  misc_feature: HIJSMM301A1Q9J.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaacggaccgaacggtaggaagtacgaaacgaactacgtaggcgtgcaccactctcgtcttctactcttcccgtcccact

SEQ ID NO: 572159 - DNA, 487 bp, Homo sapiens
  misc_feature: HIJSMM301EJLIG.52.45.E01.1.454.light.4.raw
  modified_base (428)..(428): a, c, t, g, unknown or other
cgcagtacgacacgaccggtgctcgatttagtgagtcagtaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatatttaaattggtatcagcagaaaccagggaaagcccctagactcctgatctatgctgcctccaatttgcaaagtgcgtcccatcgaggttcagtggccggggatctgggacagacttcactctcaccatcagcggtcttcaacctgaggactttggaacttactactgtcagcagagtgataatacccctnagactttcggccctgggactacagtggatgtcaaacgaactgtggctgcaccatctgtt

SEQ ID NO: 572160 - DNA, 503 bp, Homo sapiens
  misc_feature: HIJSMM301DCIKV.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaaagtggatatcaacgaactgtggctgcaccatctgtctt

SEQ ID NO: 572161 - DNA, 512 bp, Homo sapiens
  misc_feature: HIJSMM301D9WFM.43.5.A05.1.454.light.4.raw
tgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttggggcaaagctgccctgaccctttcgggtgcgcagcctgaggatgaggctgactattactgcttgctcgcctatgatgctgctcgggttttcggcggagggaccaagttgaccgtcctagggtcagcccaaggctgccccctcggtcactctcgttcccgccctcctca

SEQ ID NO: 572162 - DNA, 504 bp, Homo sapiens
  misc_feature: HIJSMM301B52X4.8.24.C02.1.454.light.4.raw
ctcgcgtgtccacgaccggtgctcgatttagtacagatcgttagggaaagggggggtcgtcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgcccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagttgaccgtcctaagtcagcccaaggctgccccctc

SEQ ID NO: 572163 - DNA, 503 bp, Homo sapiens
  misc_feature: HIJSMM301B9HPA.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtctaggtcagcccaaggctgccccctcggtcactctgtt

SEQ ID NO: 572164 - DNA, 500 bp, Homo sapiens
  misc_feature: HIJSMM301EHK5K.2.49.E05.1.454.light.4.raw
acgctcgacacacgaccggtgctcgatttagagcgactagcaacacacaaagggggggagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacaggcagcctgagtgcttatgtcttcgggaactgggaccaccgggtcaccggtcct

SEQ ID NO: 572165 - DNA, 489 bp, Homo sapiens; identical to SEQ ID NO: 553430
  misc_feature: HIJSMM301CRFN7.14.55.E11.1.454.light.4.raw

SEQ ID NO: 572166 - DNA, 483 bp, Homo sapiens
  misc_feature: HIJSMM301DH0PW.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaatagggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcta

SEQ ID NO: 572167 - DNA, 486 bp, Homo sapiens; identical to SEQ ID NO: 535385
  misc_feature: HIJSMM301CQ6Y5.19.71.G05.1.454.light.4.raw

SEQ ID NO: 572168 - DNA, 489 bp, Homo sapiens; identical to SEQ ID NO: 536013
  misc_feature: HIJSMM301CKK4T.26.23.C01.1.454.light.4.raw

SEQ ID NO: 572169 - DNA, 522 bp, Homo sapiens; identical to SEQ ID NO: 543352
  misc_feature: HIJSMM301A2VF6.27.23.C01.1.454.light.4.raw

SEQ ID NO: 572170 - DNA, 517 bp, Homo sapiens; identical to SEQ ID NO: 562257
  misc_feature: HIJSMM301DIHDO.41.25.C03.1.454.light.4.raw

SEQ ID NO: 572171 - DNA, 502 bp, Homo sapiens
  misc_feature: HIJSMM301A2BO6.9.12.B01.1.454.light.4.raw
  modified_base (428)..(428): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttcncgggcgtcgccaacggaccgaaggtaggaatacaaacgaactagtggctgcaccatctgtcttcatcttccccg

SEQ ID NO: 572172 - DNA, 492 bp, Homo sapiens; identical to SEQ ID NO: 539815
  misc_feature: HIJSMM301DO0RZ.51.81.H04.1.454.light.4.raw

SEQ ID NO: 572173 - DNA, 520 bp, Homo sapiens; identical to SEQ ID NO: 555215
  misc_feature: HIJSMM301DJJJK.40.27.C05.1.454.light.4.raw

SEQ ID NO: 572174 - DNA, 490 bp, Homo sapiens
  misc_feature: HIJSMM301CEC6K.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggccaagctggagatcaaccgaactgtggctgcaccatct

SEQ ID NO: 572175 - DNA, 485 bp, Homo sapiens
  misc_feature: HIJSMM301CRE8A.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggccctggaccatagtggatatgaaacgaactgtggctgcacc

SEQ ID NO: 572176 - DNA, 487 bp, Homo sapiens; identical to SEQ ID NO: 537009
  misc_feature: HIJSMM301DV24L.12.88.H11.1.454.light.4.raw

SEQ ID NO: 572177 - DNA, 488 bp, Homo sapiens; identical to SEQ ID NO: 536861
  misc_feature: HIJSMM301BTD15.12.88.H11.1.454.light.4.raw

SEQ ID NO: 572178 - DNA, 463 bp, Homo sapiens; identical to SEQ ID NO: 535062
  misc_feature: HIJSMM301BQVZP.11.73.G07.1.454.light.4.raw

SEQ ID NO: 572179 - DNA, 481 bp, Homo sapiens; identical to SEQ ID NO: 535993
  misc_feature: HIJSMM301C02SP.21.25.C03.1.454.light.4.raw

SEQ ID NO: 572180 - DNA, 503 bp, Homo sapiens; identical to SEQ ID NO: 535044
  misc_feature: HIJSMM301CCKP8.19.78.H01.1.454.light.4.raw

SEQ ID NO: 572181 - DNA, 447 bp, Homo sapiens; identical to SEQ ID NO: 535201
  misc_feature: HIJSMM301CQGQZ.18.9.A09.1.454.light.4.raw

SEQ ID NO: 572182 - DNA, 416 bp, Homo sapiens
  misc_feature: HIJSMM301A17J2.18.78.H01.1.454.light.4.raw
  modified_base (382)..(382): a, c, t, g, unknown or other
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagccccaaggccaaaccccnctgtcactctgttcccacctcctccatactcgta

SEQ ID NO: 572183 - DNA, 484 bp, Homo sapiens; identical to SEQ ID NO: 536162
  misc_feature: HIJSMM301AK4OB.13.59.F04.1.454.light.4.raw

SEQ ID NO: 572184 - DNA, 489 bp, Homo sapiens
  misc_feature: HIJSMM301ERQ34.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacaggcggcctcaggacttatgtcttcggaactgggacccacgttaccgtcctaggtcagaccccg

SEQ ID NO: 572185 - DNA, 491 bp, Homo sapiens; identical to SEQ ID NO: 535166
  misc_feature: HIJSMM301B65G2.47.78.H01.1.454.light.4.raw

SEQ ID NO: 572186 - DNA, 500 bp, Homo sapiens
  misc_feature: HIJSMM301D5624.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggaggaccaagctgaccgtcctaggtcagcccaaggctgccccctc

SEQ ID NO: 572187 - DNA, 521 bp, Homo sapiens
  misc_feature: HIJSMM301DVVLC.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccgccct

SEQ ID NO: 572188 - DNA, 489 bp, Homo sapiens
  misc_feature: HIJSMM301BV6NL.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtccaggtcagccc

SEQ ID NO: 572189 - DNA, 484 bp, Homo sapiens
  misc_feature: HIJSMM301AMELG.48.6.A06.1.454.light.4.raw
agtatacatacacgaccggtgctcgatttagatctactgacagggggcaggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggtccaagggaccgaaggtggaaatacaaacgaactagtggctgcacca

SEQ ID NO: 572190 - DNA, 506 bp, Homo sapiens
  misc_feature: HIJSMM301EJ3UN.18.78.H01.1.454.light.4.raw
tacgagtatgcacgaccggtgctcgatttagtgtgagtagtttgggtttggggggggtctcaggaggcagcactctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtca

SEQ ID NO: 572191 - DNA, 506 bp, Homo sapiens
  misc_feature: HIJSMM301D8JTH.48.28.C06.1.454.light.4.raw
agtatacatacacgaccggtgctcgatttagagctcacgtattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctggtcactctgttccccg

SEQ ID NO: 572192 - DNA, 491 bp, Homo sapiens
  misc_feature: HIJSMM301DHWZS.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccgggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatctgtt

SEQ ID NO: 572193 - DNA, 517 bp, Homo sapiens; identical to SEQ ID NO: 536262
  misc_feature: HIJSMM301DQZWW.14.70.G04.1.454.light.4.raw

SEQ ID NO: 572194 - DNA, 503 bp, Homo sapiens; identical to SEQ ID NO: 572101
  misc_feature: HIJSMM301BGD7M.48.67.G01.1.454.light.4.raw

SEQ ID NO: 572195 - DNA, 503 bp, Homo sapiens; identical to SEQ ID NO: 535140
  misc_feature: HIJSMM301ESWKO.18.37.D04.1.454.light.4.raw

SEQ ID NO: 572196 - DNA, 501 bp, Homo sapiens
  misc_feature: HIJSMM301EDUCU.43.38.D05.1.454.light.4.raw
tgtgagtagtcacgaccggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccaggtggaaatcaaacgaactgtggctgcaccatctgtcttcatcttccccg

SEQ ID NO: 572197 - DNA, 494 bp, Homo sapiens; identical to SEQ ID NO: 541159
  misc_feature: HIJSMM301BHQ8N.15.59.F04.1.454.light.4.raw

SEQ ID NO: 572198 - DNA, 517 bp, Homo sapiens; identical to SEQ ID NO: 541596
  misc_feature: HIJSMM301CR1T2.19.80.H03.1.454.light.4.raw

SEQ ID NO: 572199 - DNA, 500 bp, Homo sapiens
  misc_feature: HIJSMM301AJW31.3.33.C11.1.454.light.4.raw
agacgcactccacgaccggtgctcgatttagagtgagctcgttgggtttgggggggtcgtcaggaggcagcgctctcaggacgtcaccaccatggcctgggctctgctcctcctcaccctcctcactcagggcacagggtccgtgggcccacgtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacaatgttttcggcggagggaccaagctgaccgtcctaggtcagcccaaggctgccccccg

SEQ ID NO: 572200 - DNA, 495 bp, Homo sapiens; identical to SEQ ID NO: 550605
  misc_feature: HIJSMM301AX85V.41.38.D05.1.454.light.4.raw

SEQ ID NO: 572201 - DNA, 494 bp, Homo sapiens; identical to SEQ ID NO: 539922
  misc_feature: HIJSMM301DZ7N4.27.78.H01.1.454.light.4.raw

SEQ ID NO: 572202 - DNA, 515 bp, Homo sapiens
  misc_feature: HIJSMM301ELP6V.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggcccaaccccactgtcactctgttcccaccctcctcgac

SEQ ID NO: 572203 - DNA, 517 bp, Homo sapiens
  misc_feature: HIJSMM301BDH07.41.35.D02.1.454.light.4.raw
tctatactatcacgaccggtgctcgatttagcacacgatagttgggtttggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccgccct

SEQ ID NO: 572204 - DNA, 491 bp, Homo sapiens; identical to SEQ ID NO: 535294
  misc_feature: HIJSMM301AKZ4R.16.68.G02.1.454.light.4.raw

SEQ ID NO: 572205 - DNA, 510 bp, Homo sapiens
  misc_feature: HIJSMM301EPUM1.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgccaagggaccgaacggtaggaaagtacaagacgaactacgtggctgcacaactactgtcttcatcttcccgt

SEQ ID NO: 572206 - DNA, 473 bp, Homo sapiens
  misc_feature: HIJSMM301BHAQ2.48.45.E01.1.454.light.4.raw
agtatacatacacgaccggtgctcgatttagtgagtcagtaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggaggaccaagctgact

SEQ ID NO: 572207 - DNA, 454 bp, Homo sapiens; identical to SEQ ID NO: 535005
  misc_feature: HIJSMM301EIUJU.19.86.H09.1.454.light.4.raw

SEQ ID NO: 572208 - DNA, 495 bp, Homo sapiens; identical to SEQ ID NO: 538651
  misc_feature: HIJSMM301A7UH7.10.79.H02.1.454.light.4.raw

SEQ ID NO: 572209 - DNA, 486 bp, Homo sapiens; identical to SEQ ID NO: 535043
  misc_feature: HIJSMM301ECC7K.46.35.D02.1.454.light.4.raw

SEQ ID NO: 572210 - DNA, 497 bp, Homo sapiens; identical to SEQ ID NO: 534982
  misc_feature: HIJSMM301BB5LS.26.80.H03.1.454.light.4.raw

SEQ ID NO: 572211 - DNA, 484 bp, Homo sapiens
  misc_feature: HIJSMM301CW053.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccgaaggtggaatcaaacgaactgtggctgcaccta

SEQ ID NO: 572212 - DNA, 500 bp, Homo sapiens; identical to SEQ ID NO: 540219
  misc_feature: HIJSMM301EQL53.43.34.D01.1.454.light.4.raw

SEQ ID NO: 572213 - DNA, 454 bp, Homo sapiens; identical to SEQ ID NO: 535005
  misc_feature: HIJSMM301B3JSQ.19.86.H09.1.454.light.4.raw

SEQ ID NO: 572214 - DNA, 490 bp, Homo sapiens; identical to SEQ ID NO: 535234
  misc_feature: HIJSMM301DWKCV.17.21.B10.1.454.light.4.raw

SEQ ID NO: 572215 - DNA, 486 bp, Homo sapiens
  misc_feature: HIJSMM301EW4OR.49.61.F06.1.454.light.4.raw
agtcgagagacacgaccggtgctcgatttagctacgctctaagggaagggggaagagctgctcagttaggacccagagggaaccatggaaaccccagcgcagcttctcttcctcctgctactctggctcccagataccaccgcagaaattgtgttgacgcagtctccaggcaccctggtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcacc

SEQ ID NO: 572216 - DNA, 491 bp, Homo sapiens
  misc_feature: HIJSMM301C4PEO.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccaggggtggagatcagacgaactgtggctgcaccatctgt

SEQ ID NO: 572217 - DNA, 514 bp, Homo sapiens; identical to SEQ ID NO: 572132
  misc_feature: HIJSMM301EDQLX.43.59.F04.1.454.light.4.raw

SEQ ID NO: 572218 - DNA, 486 bp, Homo sapiens; identical to SEQ ID NO: 538568
  misc_feature: HIJSMM301C3IIU.47.38.D05.1.454.light.4.raw

SEQ ID NO: 572219 - DNA, 490 bp, Homo sapiens
  misc_feature: HIJSMM301BOVHK.3.10.A10.1.454.light.4.raw
agacgcactccacgaccggtgctcgatttagcgtcgatctcagggggtgggtccaggaggcagaactctgggtgtctcaccatggcccggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccactgt

SEQ ID NO: 572220 - DNA, 502 bp, Homo sapiens
  misc_feature: HIJSMM301ADU72.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaacgtgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggaccaaggtaggatatcagacgaactagtggctg

SEQ ID NO: 572221 - DNA, 514 bp, Homo sapiens; identical to SEQ ID NO: 541418
  misc_feature: HIJSMM301ADHTW.17.33.C11.1.454.light.4.raw

SEQ ID NO: 572222 - DNA, 444 bp, Homo sapiens; identical to SEQ ID NO: 535192
  misc_feature: HIJSMM301DRQRR.5.9.A09.1.454.light.4.raw

SEQ ID NO: 572223 - DNA, 491 bp, Homo sapiens
  misc_feature: HIJSMM301B36FZ.51.28.C06.1.454.light.4.raw
cgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggtca

SEQ ID NO: 572224 - DNA, 520 bp, Homo sapiens
  misc_feature: HIJSMM301BCPV0.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccgccct

SEQ ID NO: 572225 - DNA, 514 bp, Homo sapiens; identical to SEQ ID NO: 541634
  misc_feature: HIJSMM301DN14U.10.80.H03.1.454.light.4.raw

SEQ ID NO: 572226 - DNA, 503 bp, Homo sapiens
  misc_feature: HIJSMM301AY5ZB.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtcta

SEQ ID NO: 572227 - DNA, 494 bp, Homo sapiens; identical to SEQ ID NO: 535478
  misc_feature: HIJSMM301BV25M.10.79.H02.1.454.light.4.raw

SEQ ID NO: 572228 - DNA, 491 bp, Homo sapiens
  misc_feature: HIJSMM301CVOE6.8.4.A04.1.454.light.4.raw
ctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaccg

SEQ ID NO: 572229 - DNA, 487 bp, Homo sapiens; identical to SEQ ID NO: 536536
  misc_feature: HIJSMM301A2C0E.26.45.E01.1.454.light.4.raw

SEQ ID NO: 572230 - DNA, 460 bp, Homo sapiens; identical to SEQ ID NO: 537107
  misc_feature: HIJSMM301AUOWJ.22.28.C06.1.454.light.4.raw

SEQ ID NO: 572231 - DNA, 440 bp, Homo sapiens; identical to SEQ ID NO: 535667
  misc_feature: HIJSMM301CANXF.41.9.A09.1.454.light.4.raw

SEQ ID NO: 572232 - DNA, 514 bp, Homo sapiens
  misc_feature: HIJSMM301CY2NZ.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctgggtccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttccc

SEQ ID NO: 572233 - DNA, 511 bp, Homo sapiens; identical to SEQ ID NO: 541549
  misc_feature: HIJSMM301CSXLH.40.33.C11.1.454.light.4.raw

SEQ ID NO: 572234 - DNA, 513 bp, Homo sapiens
  misc_feature: HIJSMM301C4DL8.5.59.F04.1.454.light.4.raw
  modified_base (498)..(498): a, c, t, g, unknown or other
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccgaggggaaagagcccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagtattttgcagtgtattactgtcagcagtatggtagctcacggacgttcggccgaaggaccgaaggtaggaaatacaaacgaactagtggcgtgcaccactctgtcttcnttaccttcccgccta

SEQ ID NO: 572235 - DNA, 512 bp, Homo sapiens
  misc_feature: HIJSMM301C5PG2.9.38.D05.1.454.light.4.raw
  modified_base (478)..(478): a, c, t, g, unknown or other
  modified_base (480)..(480): a, c, t, g, unknown or other
  modified_base (488)..(488): a, c, t, g, unknown or other
  modified_base (500)..(500): a, c, t, g, unknown or other
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctggattatttctgcagctcaaaaagaagtagcctctcgtggttttcgcgggggacgaagtgaccgcctaagtnanccaagcgnccctccgtcacnctcgtccgccct

SEQ ID NO: 572236 - DNA, 480 bp, Homo sapiens; identical to SEQ ID NO: 556114
  misc_feature: HIJSMM301DOTLR.21.25.C03.1.454.light.4.raw

SEQ ID NO: 572237 - DNA, 504 bp, Homo sapiens
  misc_feature: HIJSMM301CRV9I.14.57.F02.1.454.light.4.raw
cgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagttattactgtcagcagcgggcaattggccgctcactttcggcggggggaccgaaggtggagttcaaacgaactgtggctgcaccatctgtcttcatcttcccgccta

SEQ ID NO: 572238 - DNA, 516 bp, Homo sapiens
  misc_feature: HIJSMM301CB36X.51.53.E09.1.454.light.4.raw
cgatcgtatacacgaccggtgctcgatttagagagagtgtgttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaacgtgaccgtcctacgtcagcccaaggctcgcccctcggtcactcttccg

SEQ ID NO: 572239 - DNA, 508 bp, Homo sapiens
  misc_feature: HIJSMM301AHJAF.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggacaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttccc

SEQ ID NO: 572240 - DNA, 498 bp, Homo sapiens
  misc_feature: HIJSMM301DLXP3.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcattattgtaatttcggtggagggaccaaggtggaggtcaaacgaactgtggctgcaccatctgtcttcatcttccccg

SEQ ID NO: 572241 - DNA, 520 bp, Homo sapiens
  misc_feature: HIJSMM301C6MLJ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgagacgaggctgattattattgtagttcatatacaaccagtgacacttgggtgttcggcggagggaccaggctgaccgtcctaggtcagcccaaggctgccccctcggtcactctgttcccgccct

SEQ ID NO: 572242 - DNA, 482 bp, Homo sapiens
  misc_feature: HIJSMM301CQ8VQ.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtgggtcccatcaaggttcagcggcagtgggtctgggacagaattcactctcaccatcagcagcctgcaacctgatgactttgcaacttattactgccaacagtataatgttatgaatcactttgccaggaccaagctggagatcaacgaactagtggctgcacca

SEQ ID NO: 572243 - DNA, 501 bp, Homo sapiens
  misc_feature: HIJSMM301EM78A.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagcccaaggctgcccctcggtcactctgttccccg

SEQ ID NO: 572244 - DNA, 512 bp, Homo sapiens; identical to SEQ ID NO: 556539
  misc_feature: HIJSMM301D4MCO.5.58.F03.1.454.light.4.raw

SEQ ID NO: 572245 - DNA, 464 bp, Homo sapiens; identical to SEQ ID NO: 537982
  misc_feature: HIJSMM301BHHGT.17.28.C06.1.454.light.4.raw

SEQ ID NO: 572246 - DNA, 486 bp, Homo sapiens; identical to SEQ ID NO: 538568
  misc_feature: HIJSMM301DJBGH.47.38.D05.1.454.light.4.raw

SEQ ID NO: 572247 - DNA, 502 bp, Homo sapiens
  misc_feature: HIJSMM301CSGME.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcgagggaccaagctgaccgtcctgcgtcagcccaaggctgccccctcggtcactt

SEQ ID NO: 572248 - DNA, 471 bp, Homo sapiens
  misc_feature: HIJSMM301B1M79.51.67.G01.1.454.light.4.raw
cgatcgtatacacgaccggtgctcgatttagagtatacatattgggtttggggcagtcccaaccaggacacagcatggacatgagggtccctgctcagctcctggggctcctgctgctctggctctcaggtgccagatgtgtcatccagatgacccagtctccatcctccctgtctgcatctataggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtgg

SEQ ID NO: 572249 - DNA, 455 bp, Homo sapiens; identical to SEQ ID NO: 535447
  misc_feature: HIJSMM301BDOQW.19.71.G05.1.454.light.4.raw

SEQ ID NO: 572250 - DNA, 509 bp, Homo sapiens; identical to SEQ ID NO: 541168
  misc_feature: HIJSMM301CANM9.5.60.F05.1.454.light.4.raw

SEQ ID NO: 572251 - DNA, 498 bp, Homo sapiens
  misc_feature: HIJSMM301AK6SU.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaaggaccgaggtaggaaatacaaacgaactagtggctgcaccatctcgtcttcatt

SEQ ID NO: 572252 - DNA, 500 bp, Homo sapiens; identical to SEQ ID NO: 540012
  misc_feature: HIJSMM301DPPLD.52.34.D01.1.454.light.4.raw

SEQ ID NO: 572253 - DNA, 495 bp, Homo sapiens; identical to SEQ ID NO: 563606
  misc_feature: HIJSMM301DPLHH.5.12.B01.1.454.light.4.raw

SEQ ID NO: 572254 - DNA, 483 bp, Homo sapiens; identical to SEQ ID NO: 547051
  misc_feature: HIJSMM301CCENI.46.26.C04.1.454.light.4.raw

SEQ ID NO: 572255 - DNA, 500 bp, Homo sapiens
  misc_feature: HIJSMM301CWKR4.49.77.G11.1.454.light.4.raw
agtcgagagacacgaccggtgctcgatttagctagtcactcaagggaaaggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcgagcccaacggccaacccacctcgtcactctcg

SEQ ID NO: 572256 - DNA, 484 bp, Homo sapiens; identical to SEQ ID NO: 536162
  misc_feature: HIJSMM301C5O6I.13.59.F04.1.454.light.4.raw

SEQ ID NO: 572257 - DNA, 484 bp, Homo sapiens; identical to SEQ ID NO: 535400
  misc_feature: HIJSMM301DT69F.46.26.C04.1.454.light.4.raw

SEQ ID NO: 572258 - DNA, 509 bp, Homo sapiens; identical to SEQ ID NO: 544573
  misc_feature: HIJSMM301CRV5Q.10.88.H11.1.454.light.4.raw

SEQ ID NO: 572259 - DNA, 493 bp, Homo sapiens
  misc_feature: HIJSMM301AMITK.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggcctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaagg

SEQ ID NO: 572260 - DNA, 509 bp, Homo sapiens
  misc_feature: HIJSMM301CN62R.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaaagcccccaaactcatcatttatgatgtcagtaatcggccctcaggggtttctaatcgcttctctggctccaagtctggcaacacggcctccctgaccatctctgggctccaggctgatgacaggctgattattactgcaggtcatatacaaatcagcaaacacttaatgtcttcgggactgggaccaagaatcaccgtcctacgtcagcccaacggccaaccccaactgtcta

SEQ ID NO: 572261 - DNA, 508 bp, Homo sapiens
  misc_feature: HIJSMM301C59XX.15.59.F04.1.454.light.4.raw
tctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctgggtccctgatcgcttctctggctccatccttggaaacaaagctgccctcaccatcacgggggcccaggcagatgatgaatctgtttattattgtgtcctatatatgggtgctggctatttcggtcttcggcggagggaccaagctgaccgtcctaggtcagcccaaggctcgccccctcggt

SEQ ID NO: 572262 - DNA, 491 bp, Homo sapiens; identical to SEQ ID NO: 538021
  misc_feature: HIJSMM301C5Z9X.3.72.G06.1.454.light.4.raw

SEQ ID NO: 572263 - DNA, 479 bp, Homo sapiens; identical to SEQ ID NO: 535188
  misc_feature: HIJSMM301EW09X.10.74.G08.1.454.light.4.raw

SEQ ID NO: 572264 - DNA, 474 bp, Homo sapiens; identical to SEQ ID NO: 561309
  misc_feature: HIJSMM301AQ5C6.5.12.B01.1.454.light.4.raw

SEQ ID NO: 572265 - DNA, 487 bp, Homo sapiens
  misc_feature: HIJSMM301A53MX.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctcgtacacttttggccaggggaccaagttggagatcaaacgaact

SEQ ID NO: 572266 - DNA, 491 bp, Homo sapiens
  misc_feature: HIJSMM301AQPIT.51.82.H05.1.454.light.4.raw
cgatcgtatacacgaccggtgctcgatttagtcgagctctctcgcggggcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacagcccccaaactcctcatccatgataccagaaatcggccctcgggggtccctgaccgattctctggctccaagtctgacacttcagcctccctggccatcactgggctccagactgaggatgaggctgactattactgccagtcctatgacagcaggctgactgctgtggttttcggcggcgggaccaagctgaccgtcctaggtcacg

SEQ ID NO: 572267 - DNA, 383 bp, Homo sapiens; identical to SEQ ID NO: 543660
  misc_feature: HIJSMM301BUB8B.41.37.D04.1.454.light.4.raw

SEQ ID NO: 572268 - DNA, 454 bp, Homo sapiens; identical to SEQ ID NO: 534964
  misc_feature: HIJSMM301C5Z5J.19.86.H09.1.454.light.4.raw

SEQ ID NO: 572269 - DNA, 492 bp, Homo sapiens; identical to SEQ ID NO: 559998
  misc_feature: HIJSMM301CDO64.49.17.B06.1.454.light.4.raw

SEQ ID NO: 572270 - DNA, 476 bp, Homo sapiens; identical to SEQ ID NO: 547708
  misc_feature: HIJSMM301AEZLP.12.1.A01.1.454.light.4.raw

SEQ ID NO: 572271 - DNA, 503 bp, Homo sapiens
  misc_feature: HIJSMM301CDCZI.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactagtggctgcaccatctgtcttcatcttcccgccta

SEQ ID NO: 572272 - DNA, 512 bp, Homo sapiens
  misc_feature: HIJSMM301BPYUT.15.76.G10.1.454.light.4.raw
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccgccctcctcgctacg

SEQ ID NO: 572273 - DNA, 496 bp, Homo sapiens; identical to SEQ ID NO: 537925
  misc_feature: HIJSMM301E0EMU.22.14.B03.1.454.light.4.raw

SEQ ID NO: 572274 - DNA, 497 bp, Homo sapiens
  misc_feature: HIJSMM301A7FT4.15.58.F03.1.454.light.4.raw
tctacgtagccacgaccggtgctcgatttagtctgatcgagaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcacagcaactggttactctctttcggcggagggaccaaggtggagatacaaacgaactgtggctgcaccatctgtcttcta

SEQ ID NO: 572275 - DNA, 487 bp, Homo sapiens
  misc_feature: HIJSMM301B1SMT.22.86.H09.1.454.light.4.raw
acatacgcgtcacgaccggtgctcgatttagtgctatagacttgggtttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctcctgaccatctctgggctccaggctgaagatgaggctgattattactgctgctcatttgcaggcgcctacacttgggtgttcggcggagggaccaagctgaccgtcctaggtcagcccaa

SEQ ID NO: 572276 - DNA, 521 bp, Homo sapiens; identical to SEQ ID NO: 539470
  misc_feature: HIJSMM301BNXLX.27.23.C01.1.454.light.4.raw

SEQ ID NO: 572277 - DNA, 452 bp, Homo sapiens
  misc_feature: HIJSMM301CR1M4.13.23.C01.1.454.light.4.raw
tcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatttacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgccccatcggtcactctgttcccaccctcctctagtacgtga

SEQ ID NO: 572278 - DNA, 498 bp, Homo sapiens
  misc_feature: HIJSMM301DDM7Z.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccacgactgaccgtcctaggtcagcccaaggctgcccctcggtcactctgttcccgccctcctccactactatg

SEQ ID NO: 572279 - DNA, 489 bp, Homo sapiens; identical to SEQ ID NO: 549568
  misc_feature: HIJSMM301CMVP6.43.33.C11.1.454.light.4.raw

SEQ ID NO: 572280 - DNA, 502 bp, Homo sapiens; identical to SEQ ID NO: 539314
  misc_feature: HIJSMM301DQ5Z4.21.81.H04.1.454.light.4.raw

SEQ ID NO: 572281 - DNA, 508 bp, Homo sapiens
  misc_feature: HIJSMM301CNRQS.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactaggaaatcagcagggtggaggctgaggatgttggggtttattactgcatgcaactacacacggccgctcactttcggcggagggaccgaaggtggagatacaaacgaactgtggctgcaccatctgtt

SEQ ID NO: 572282 - DNA, 521 bp, Homo sapiens; identical to SEQ ID NO: 538715
  misc_feature: HIJSMM301EICTU.27.23.C01.1.454.light.4.raw

SEQ ID NO: 572283 - DNA, 520 bp, Homo sapiens
  misc_feature: HIJSMM301DN5HL.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacgaagggggtcgggatccctgatcgcttctcgggctccagctcgtggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtccactctgttcccgccctcctcacg

SEQ ID NO: 572284 - DNA, 485 bp, Homo sapiens; identical to SEQ ID NO: 543370
  misc_feature: HIJSMM301DP774.3.10.A10.1.454.light.4.raw

SEQ ID NO: 572285 - DNA, 488 bp, Homo sapiens; identical to SEQ ID NO: 537055
  misc_feature: HIJSMM301CRFHU.4.64.F09.1.454.light.4.raw

SEQ ID NO: 572286 - DNA, 497 bp, Homo sapiens
  misc_feature: HIJSMM301CFM4M.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccgacgggaccgacggtcggagtgtctaagcgaaccgtgtggcgtggcaccactcttcg

SEQ ID NO: 572287 - DNA, 489 bp, Homo sapiens; identical to SEQ ID NO: 536663
  misc_feature: HIJSMM301CX29F.16.72.G06.1.454.light.4.raw

SEQ ID NO: 572288 - DNA, 480 bp, Homo sapiens; identical to SEQ ID NO: 557442
  misc_feature: HIJSMM301AERM2.8.53.E09.1.454.light.4.raw

SEQ ID NO: 572289 - DNA, 520 bp, Homo sapiens; identical to SEQ ID NO: 567791
  misc_feature: HIJSMM301CZLYC.27.23.C01.1.454.light.4.raw

SEQ ID NO: 572290 - DNA, 486 bp, Homo sapiens; identical to SEQ ID NO: 535043
  misc_feature: HIJSMM301A3PL3.46.35.D02.1.454.light.4.raw

SEQ ID NO: 572291 - DNA, 485 bp, Homo sapiens
  misc_feature: HIJSMM301ALHYV.26.60.F05.1.454.light.4.raw
agactatactcacgaccggtgctcgatttagtacgtcatcagggaaagggggagggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 572292 - DNA, 496 bp, Homo sapiens; identical to SEQ ID NO: 535541
  misc_feature: HIJSMM301EGFW0.3.33.C11.1.454.light.4.raw

SEQ ID NO: 572293 - DNA, 493 bp, Homo sapiens; identical to SEQ ID NO: 535084
  misc_feature: HIJSMM301AQD0Q.47.64.F09.1.454.light.4.raw

SEQ ID NO: 572294 - DNA, 514 bp, Homo sapiens; identical to SEQ ID NO: 541502
  misc_feature: HIJSMM301DBLZN.15.34.D01.1.454.light.4.raw

SEQ ID NO: 572295 - DNA, 493 bp, Homo sapiens; identical to SEQ ID NO: 544835
  misc_feature: HIJSMM301BZIGZ.43.29.C07.1.454.light.4.raw

SEQ ID NO: 572296 - DNA, 472 bp, Homo sapiens
  misc_feature: HIJSMM301ES260.7.81.H04.1.454.light.4.raw
cgtgtctctacacgaccggtgctcgatttagtagtgtagattcgcgggggagtcagtcctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtgg

SEQ ID NO: 572297 - DNA, 489 bp, Homo sapiens; identical to SEQ ID NO: 543840
  misc_feature: HIJSMM301DY3W8.12.88.H11.1.454.light.4.raw

SEQ ID NO: 572298 - DNA, 507 bp, Homo sapiens; identical to SEQ ID NO: 535641
  misc_feature: HIJSMM301EZ264.10.88.H11.1.454.light.4.raw

SEQ ID NO: 572299 - DNA, 495 bp, Homo sapiens; identical to SEQ ID NO: 545507
  misc_feature: HIJSMM301AIVKJ.49.22.B11.1.454.light.4.raw

SEQ ID NO: 572300 - DNA, 485 bp, Homo sapiens; identical to SEQ ID NO: 535880
  misc_feature: HIJSMM301A1SUO.7.75.G09.1.454.light.4.raw

SEQ ID NO: 572301 - DNA, 371 bp, Homo sapiens
  misc_feature: HIJSMM301BH32F.41.34.D01.1.454.light.4.raw
tctatactatcacgaccggtgctcgatttagatcgtctgtgttgggtttgggggcaggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacga

SEQ ID NO: 572302 - DNA, 497 bp, Homo sapiens; identical to SEQ ID NO: 571085
  misc_feature: HIJSMM301EP8SR.5.24.C02.1.454.light.4.raw

SEQ ID NO: 572303 - DNA, 474 bp, Homo sapiens; identical to SEQ ID NO: 561309
  misc_feature: HIJSMM301BKOGK.5.12.B01.1.454.light.4.raw

SEQ ID NO: 572304 - DNA, 481 bp, Homo sapiens; identical to SEQ ID NO: 535993
  misc_feature: HIJSMM301ARK5K.21.25.C03.1.454.light.4.raw

SEQ ID NO: 572305 - DNA, 489 bp, Homo sapiens; identical to SEQ ID NO: 535620
  misc_feature: HIJSMM301EAVZG.47.38.D05.1.454.light.4.raw

SEQ ID NO: 572306 - DNA, 464 bp, Homo sapiens; identical to SEQ ID NO: 536640
  misc_feature: HIJSMM301DQ73K.26.78.H01.1.454.light.4.raw

SEQ ID NO: 572307 - DNA, 494 bp, Homo sapiens; identical to SEQ ID NO: 540110
  misc_feature: HIJSMM301ETRHC.51.71.G05.1.454.light.4.raw

SEQ ID NO: 572308 - DNA, 489 bp, Homo sapiens; identical to SEQ ID NO: 535139
  misc_feature: HIJSMM301EH73Y.14.55.E11.1.454.light.4.raw

SEQ ID NO: 572309 - DNA, 470 bp, Homo sapiens; identical to SEQ ID NO: 536130
  misc_feature: HIJSMM301AU4AN.7.81.H04.1.454.light.4.raw

SEQ ID NO: 572310 - DNA, 486 bp, Homo sapiens; identical to SEQ ID NO: 535458
  misc_feature: HIJSMM301C64UH.7.75.G09.1.454.light.4.raw

SEQ ID NO: 572311 - DNA, 521 bp, Homo sapiens; identical to SEQ ID NO: 538715
  misc_feature: HIJSMM301DMJLZ.27.23.C01.1.454.light.4.raw

SEQ ID NO: 572312 - DNA, 504 bp, Homo sapiens; identical to SEQ ID NO: 543517
  misc_feature: HIJSMM301DI462.48.86.H09.1.454.light.4.raw

SEQ ID NO: 572313 - DNA, 510 bp, Homo sapiens
  misc_feature: HIJSMM301BQ3PL.48.23.C01.1.454.light.4.raw
  modified_base (456)..(456): a, c, t, g, unknown or other
agtatacatacacgaccggtgctcgatttagtacacgtgattagggattggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggngttcggcggagggaccaagttgaccgtcctaggtcaacccaaggctgccccccg

SEQ ID NO: 572314 - DNA, 492 bp, Homo sapiens
  misc_feature: HIJSMM301EUGU4.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactagaaaatcagccgggtggggctgaggatgttggcatttattactgcatgcaggctatacaccttcctcgcctacttttggccaggggacccaagctggagatcaggcgtaacg

SEQ ID NO: 572315 - DNA, 492 bp, Homo sapiens; identical to SEQ ID NO: 549170
  misc_feature: HIJSMM301DHJKH.40.81.H04.1.454.light.4.raw

SEQ ID NO: 572316 - DNA, 493 bp, Homo sapiens; identical to SEQ ID NO: 535084
  misc_feature: HIJSMM301CF49N.47.64.F09.1.454.light.4.raw

SEQ ID NO: 572317 - DNA, 495 bp, Homo sapiens
  misc_feature: HIJSMM301EMRWV.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaaccccactgtcact

SEQ ID NO: 572318 - DNA, 474 bp, Homo sapiens; identical to SEQ ID NO: 536581
  misc_feature: HIJSMM301DQBV4.7.81.H04.1.454.light.4.raw

SEQ ID NO: 572319 - DNA, 489 bp, Homo sapiens; identical to SEQ ID NO: 543840
  misc_feature: HIJSMM301A1NMW.12.88.H11.1.454.light.4.raw

SEQ ID NO: 572320 - DNA, 497 bp, Homo sapiens
  misc_feature: HIJSMM301C4OR5.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccgaaggaccgaaggtaggaatacaaacgaactagtggcgtgcgaccatctgtt

SEQ ID NO: 572321 - DNA, 486 bp, Homo sapiens; identical to SEQ ID NO: 536329
  misc_feature: HIJSMM301EPKRA.21.4.A04.1.454.light.4.raw

SEQ ID NO: 572322 - DNA, 507 bp, Homo sapiens; identical to SEQ ID NO: 538178
  misc_feature: HIJSMM301CVPIG.8.42.D09.1.454.light.4.raw

SEQ ID NO: 572323 - DNA, 502 bp, Homo sapiens
  misc_feature: HIJSMM301CIIU7.49.43.D10.1.454.light.4.raw
agtcgagagacacgaccggtgctcgatttagactagcagtaaggggagagaagacaggactcaggacaatctccagcatggccagcttccctctcctcctcaccctcctcactcactgtgcagggtcctgggcccagtctgtgctgactcagccaccctcagcgtctgggactcccgggcagagggtcaccatctcttgttctggaggcagctccaacatcggaagtaatgatgttaactggtaccaacaaattccagggacggcccccaatgtcttcatctttggtaatgatcagcggccctcaggggtccctgaccgattctctggctccaagtctggcacctcagcctccctggccatcagtgggctccagtctgaggatgaggctgattattactgtgcaacatgggatgacagcctgaatgccgtggttttcggcggagggaccaaggtgaccgtcctaggtcagcccaaggctgcccctcggtcactctgttcccg

SEQ ID NO: 572324 - DNA, 511 bp, Homo sapiens
  misc_feature: HIJSMM301CAAS4.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctcctgacaatctctgggctccaggctgaggacgaggcggattattactgttgctcatatgcgggtagtagcactttcgatgtcctattcggcggagggaccaagctgacccgtcctgggtcagcccaaggctcgccccctcggt

SEQ ID NO: 572325 - DNA, 498 bp, Homo sapiens
  misc_feature: HIJSMM301AKXSE.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgtaggctgaagatgtggcagtttattactgtcagcaatattatattcctcctcagacgttcggccaagggaccaaggtggaaatcaaacgaactgtggctgcacc

SEQ ID NO: 572326 - DNA, 484 bp, Homo sapiens; identical to SEQ ID NO: 538770
  misc_feature: HIJSMM301C7BZC.4.57.F02.1.454.light.4.raw

SEQ ID NO: 572327 - DNA, 494 bp, Homo sapiens
  misc_feature: HIJSMM301EJLU7.16.6.A06.1.454.light.4.raw
tgtactactccacgaccggtgctcgatttagatctactgacagggggagcgtacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtgagatcaaacgaactgtggctgcaccat

SEQ ID NO: 572328 - DNA, 504 bp, Homo sapiens; identical to SEQ ID NO: 550923
  misc_feature: HIJSMM301BQXI0.51.2.A02.1.454.light.4.raw

SEQ ID NO: 572329 - DNA, 533 bp, Homo sapiens
  misc_feature: HIJSMM301EF8XB.52.29.C07.1.454.light.4.raw
cgcagtacgacacgaccggtgctcgatttagagtgctacgaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcattatttatggtgtcggtgaccggcctcaggggtttcgaatcacttctctggctccaagtccggcaacacggcctccctgaccatctctgggctccaggccgaggacgaggctgattattactgcgcctcatatacaaaacaacaacaattgggtgttcggcggagggaccaagctgaccgtcctaggtcagcccaaggctgccccctcggtcactctgttcccgccctcctctatacg

SEQ ID NO: 572330 - DNA, 484 bp, Homo sapiens; identical to SEQ ID NO: 535400
  misc_feature: HIJSMM301B0DRB.46.26.C04.1.454.light.4.raw

SEQ ID NO: 572331 - DNA, 500 bp, Homo sapiens; identical to SEQ ID NO: 542309
  misc_feature: HIJSMM301AUC43.12.86.H09.1.454.light.4.raw

SEQ ID NO: 572332 - DNA, 503 bp, Homo sapiens
  misc_feature: HIJSMM301EIS6T.48.71.G05.1.454.light.4.raw
agtatacatacacgaccggtgctcgatttagtgtcgtcgcaagagagagggggagagaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatt

SEQ ID NO: 572333 - DNA, 481 bp, Homo sapiens
  misc_feature: HIJSMM301CG2EO.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtgggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcaccat

SEQ ID NO: 572334 - DNA, 513 bp, Homo sapiens; identical to SEQ ID NO: 565259
  misc_feature: HIJSMM301AXD92.17.33.C11.1.454.light.4.raw

SEQ ID NO: 572335 - DNA, 502 bp, Homo sapiens; identical to SEQ ID NO: 536253
  misc_feature: HIJSMM301BBI7V.21.22.B11.1.454.light.4.raw

SEQ ID NO: 572336 - DNA, 487 bp, Homo sapiens; identical to SEQ ID NO: 543396
  misc_feature: HIJSMM301CHRYW.46.26.C04.1.454.light.4.raw

SEQ ID NO: 572337 - DNA, 491 bp, Homo sapiens; identical to SEQ ID NO: 535294
  misc_feature: HIJSMM301DH9SS.16.68.G02.1.454.light.4.raw

SEQ ID NO: 572338 - DNA, 515 bp, Homo sapiens; identical to SEQ ID NO: 543484
  misc_feature: HIJSMM301DE1M0.14.19.B08.1.454.light.4.raw

SEQ ID NO: 572339 - DNA, 488 bp, Homo sapiens
  misc_feature: HIJSMM301BK80Y.22.29.C07.1.454.light.4.raw
  modified_base (458)..(458): a, c, t, g, unknown or other
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcgccaggacaaggtggaagtnaacgaactagtggcgtgcaccatctgtctt

SEQ ID NO: 572340 - DNA, 498 bp, Homo sapiens; identical to SEQ ID NO: 554282
  misc_feature: HIJSMM301B9DIU.9.27.C05.1.454.light.4.raw

SEQ ID NO: 572341 - DNA, 483 bp, Homo sapiens
  misc_feature: HIJSMM301APHW2.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattatattgccagtcctatgacaacaccctgcgtggttttggtctgttcggtcggcgggaccg

SEQ ID NO: 572342 - DNA, 480 bp, Homo sapiens; identical to SEQ ID NO: 568031
  misc_feature: HIJSMM301CEQPB.13.48.E04.1.454.light.4.raw

SEQ ID NO: 572343 - DNA, 480 bp, Homo sapiens
  misc_feature: HIJSMM301BAF3B.49.37.D04.1.454.light.4.raw
agtcgagagacacgaccggtgctcgatttagtagcatactgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagagtggatatac

SEQ ID NO: 572344 - DNA, 489 bp, Homo sapiens
  misc_feature: HIJSMM301AJLDP.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaaggctggagatcaaacgaactgtggctgcacc

SEQ ID NO: 572345 - DNA, 494 bp, Homo sapiens; identical to SEQ ID NO: 534994
  misc_feature: HIJSMM301BZ5KS.27.78.H01.1.454.light.4.raw

SEQ ID NO: 572346 - DNA, 521 bp, Homo sapiens
  misc_feature: HIJSMM301DI9Z1.27.23.C01.1.454.light.4.raw
  modified_base (447)..(447): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattatattgtagttcatatacaaccagtgacacttgggtnttcggcgagggaccaggctgaccgtcctaggtcagcccaaggctgccccctcggtcactctgttcccgccctcc

SEQ ID NO: 572347 - DNA, 491 bp, Homo sapiens; identical to SEQ ID NO: 538021
  misc_feature: HIJSMM301DO0BL.3.72.G06.1.454.light.4.raw

SEQ ID NO: 572348 - DNA, 503 bp, Homo sapiens; identical to SEQ ID NO: 538884
  misc_feature: HIJSMM301CK40X.27.78.H01.1.454.light.4.raw

SEQ ID NO: 572349 - DNA, 499 bp, Homo sapiens; identical to SEQ ID NO: 543600
  misc_feature: HIJSMM301CT66P.14.23.C01.1.454.light.4.raw

SEQ ID NO: 572350 - DNA, 515 bp, Homo sapiens; identical to SEQ ID NO: 559738
  misc_feature: HIJSMM301EAZRJ.43.23.C01.1.454.light.4.raw

SEQ ID NO: 572351 - DNA, 485 bp, Homo sapiens
  misc_feature: HIJSMM301AMZQF.41.33.C11.1.454.light.4.raw
tctatactatcacgaccggtgctcgatttagagtgagctcgttgggtttggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaagtggatttcaaacgaactgtggctgcacc

SEQ ID NO: 572352 - DNA, 488 bp, Homo sapiens; identical to SEQ ID NO: 535081
  misc_feature: HIJSMM301CP8XQ.26.23.C01.1.454.light.4.raw

SEQ ID NO: 572353 - DNA, 494 bp, Homo sapiens; identical to SEQ ID NO: 534992
  misc_feature: HIJSMM301CFA7B.9.1.A01.1.454.light.4.raw

SEQ ID NO: 572354 - DNA, 502 bp, Homo sapiens; identical to SEQ ID NO: 542554
  misc_feature: HIJSMM301CSP4Y.48.67.G01.1.454.light.4.raw

SEQ ID NO: 572355 - DNA, 487 bp, Homo sapiens
  misc_feature: HIJSMM301C1OOY.10.59.F04.1.454.light.4.raw
catagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcgtaccgcttgggtgttcggcggagggaccaagctgaccgtcctaggtcagccccg

SEQ ID NO: 572356 - DNA, 478 bp, Homo sapiens; identical to SEQ ID NO: 535129
  misc_feature: HIJSMM301B5WUA.11.11.A11.1.454.light.4.raw

SEQ ID NO: 572357 - DNA, 495 bp, Homo sapiens; identical to SEQ ID NO: 538359
  misc_feature: HIJSMM301EHPCH.11.59.F04.1.454.light.4.raw

SEQ ID NO: 572358 - DNA, 480 bp, Homo sapiens; identical to SEQ ID NO: 559070
  misc_feature: HIJSMM301BBBII.21.25.C03.1.454.light.4.raw

SEQ ID NO: 572359 - DNA, 493 bp, Homo sapiens
  misc_feature: HIJSMM301ES0RI.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtccgctcactttcggcgggggaccgaaggtggagttcaacgaactgtggctgcaccatctgtcttcatt

SEQ ID NO: 572360 - DNA, 485 bp, Homo sapiens
  misc_feature: HIJSMM301BVSP9.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagattttgcagtttattactgtcagcagcgtagcaactggctcatcaccttcggccagggacacgactggagatgaaacgaactgtggctgcacca

SEQ ID NO: 572361 - DNA, 494 bp, Homo sapiens; identical to SEQ ID NO: 537607
  misc_feature: HIJSMM301B7IUT.52.10.A10.1.454.light.4.raw

SEQ ID NO: 572362 - DNA, 472 bp, Homo sapiens
  misc_feature: HIJSMM301DWSMH.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccaaggtggagatcaagcgaactgtgg

SEQ ID NO: 572363 - DNA, 463 bp, Homo sapiens; identical to SEQ ID NO: 535062
  misc_feature: HIJSMM301DID50.11.73.G07.1.454.light.4.raw

SEQ ID NO: 572364 - DNA, 495 bp, Homo sapiens
  misc_feature: HIJSMM301AK1EL.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgattattactgcagctcatatacaagcaccagcactctctatgtcttcggactgggaccaggtcacgtctaggtcagcccaagccaaccc

SEQ ID NO: 572365 - DNA, 493 bp, Homo sapiens; identical to SEQ ID NO: 535047
  misc_feature: HIJSMM301C41N4.16.53.E09.1.454.light.4.raw

SEQ ID NO: 572366 - DNA, 472 bp, Homo sapiens; identical to SEQ ID NO: 571291
  misc_feature: HIJSMM301C2LO7.18.76.G10.1.454.light.4.raw

SEQ ID NO: 572367 - DNA, 492 bp, Homo sapiens
  misc_feature: HIJSMM301DK869.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggcccgtcggaccgagagtggagtagtcaaacgaactagt

SEQ ID NO: 572368 - DNA, 485 bp, Homo sapiens
  misc_feature: HIJSMM301E2C4U.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgcttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaaccgtcctaggtcagcccaaggctgccccccg

SEQ ID NO: 572369 - DNA, 490 bp, Homo sapiens
  misc_feature: HIJSMM301EHJZ6.43.71.G05.1.454.light.4.raw
tgtgagtagtcacgaccggtgctcgatttagtgtcgtcgcaagagagaggggggaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatacaaacgaactgtggctgcaccat

SEQ ID NO: 572370 - DNA, 518 bp, Homo sapiens; identical to SEQ ID NO: 539372
  misc_feature: HIJSMM301D7XFG.7.86.H09.1.454.light.4.raw

SEQ ID NO: 572371 - DNA, 512 bp, Homo sapiens
  misc_feature: HIJSMM301END48.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccagggaccgaacggtaggaagtcaaacgaactagtggcgtgcaccactctgtcttcactcttcccgtccact

SEQ ID NO: 572372 - DNA, 484 bp, Homo sapiens; identical to SEQ ID NO: 537086
  misc_feature: HIJSMM301BE9G3.5.39.D06.1.454.light.4.raw

SEQ ID NO: 572373 - DNA, 478 bp, Homo sapiens
  misc_feature: HIJSMM301AGAV3.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcacccttggcgggggaccaaggtggagatacaacgaactgtggctgcacc

SEQ ID NO: 572374 - DNA, 514 bp, Homo sapiens
  misc_feature: HIJSMM301CW0NI.14.19.B08.1.454.light.4.raw
  modified_base (180)..(180): a, c, t, g, unknown or other
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccacctcctcg

SEQ ID NO: 572375 - DNA, 486 bp, Homo sapiens; identical to SEQ ID NO: 535043
  misc_feature: HIJSMM301BWJXW.46.35.D02.1.454.light.4.raw

SEQ ID NO: 572376 - DNA, 491 bp, Homo sapiens; identical to SEQ ID NO: 538388
  misc_feature: HIJSMM301AXKTJ.51.81.H04.1.454.light.4.raw

SEQ ID NO: 572377 - DNA, 514 bp, Homo sapiens; identical to SEQ ID NO: 546238
  misc_feature: HIJSMM301EQPVK.47.85.H08.1.454.light.4.raw

SEQ ID NO: 572378 - DNA, 503 bp, Homo sapiens; identical to SEQ ID NO: 539069
  misc_feature: HIJSMM301A59A3.48.26.C04.1.454.light.4.raw

SEQ ID NO: 572379 - DNA, 498 bp, Homo sapiens; identical to SEQ ID NO: 562302
  misc_feature: HIJSMM301D1LQ9.41.3.A03.1.454.light.4.raw

SEQ ID NO: 572380 - DNA, 495 bp, Homo sapiens; identical to SEQ ID NO: 535007
  misc_feature: HIJSMM301AFMJS.22.5.A05.1.454.light.4.raw

SEQ ID NO: 572381 - DNA, 462 bp, Homo sapiens; identical to SEQ ID NO: 537922
  misc_feature: HIJSMM301CN67C.10.9.A09.1.454.light.4.raw

SEQ ID NO: 572382 - DNA, 514 bp, Homo sapiens; identical to SEQ ID NO: 546238
  misc_feature: HIJSMM301EA59V.47.85.H08.1.454.light.4.raw

SEQ ID NO: 572383 - DNA, 503 bp, Homo sapiens
  misc_feature: HIJSMM301AFOC4.43.62.F07.1.454.light.4.raw
tgtgagtagtcacgaccggtgctcgatttagtagtcgcataaagggaaagggggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtggaaagcaaacgaactagtggctgcaccatctgtcttcatcttccccg

SEQ ID NO: 572384 - DNA, 492 bp, Homo sapiens; identical to SEQ ID NO: 535126
  misc_feature: HIJSMM301CBXM2.18.11.A11.1.454.light.4.raw

SEQ ID NO: 572385 - DNA, 504 bp, Homo sapiens; identical to SEQ ID NO: 535561
  misc_feature: HIJSMM301BTJCA.4.57.F02.1.454.light.4.raw

SEQ ID NO: 572386 - DNA, 493 bp, Homo sapiens
  misc_feature: HIJSMM301BJPAU.3.12.B01.1.454.light.4.raw
  modified_base (426)..(426): a, c, t, g, unknown or other
agacgcactccacgaccggtgctcgatttagtagtgtagattccgcggggtggggaggaactgctcagttaggacccagacggaaccatggaagccccagcgcagcttctcttcctcctgctactctggctcccagatatcactggagaaacagtgctgacgcagtctccagccaccctgtctgtgtctccaggggaaagagccaccctctcctgcagggccagtcagagtgttagtagcaacttagcctggtaccagcatattcttggccaggctcccaggctcctcatctatggtgcatccacccgggccactggtatcccagccaggttcagtggcagtgggtctcggacagagttcactctcaccatcagcagcctggagtctgaagactctgcagtttatactgtcagcagtataattacnggccgtggacgttcggccaagggaccaaggtggaaatcaaacgaactgtggctgcaccatctgtctt

SEQ ID NO: 572387 - DNA, 505 bp, Homo sapiens
  misc_feature: HIJSMM301DQW5B.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgaccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcagtgggtattcggcggagggaccaagctgaccgtcctaggtcagcccaaggcctcgccccctcggtcctac

SEQ ID NO: 572388 - DNA, 444 bp, Homo sapiens
  misc_feature: HIJSMM301APIWW.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaatggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtcgagcgt

SEQ ID NO: 572389 - DNA, 489 bp, Homo sapiens
  misc_feature: HIJSMM301BO3JL.41.22.B11.1.454.light.4.raw
tctatactatcacgaccggtgctcgatttagacgacagctcagggggaagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccatcagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactgtcaccagtatgcaatctcacccaggacgttcggccaagggaccagggtggaaatcaagcgaactgtggctgcaccatctgtctt

SEQ ID NO: 572390 - DNA, 482 bp, Homo sapiens; identical to SEQ ID NO: 558052
  misc_feature: HIJSMM301C8PPX.49.81.H04.1.454.light.4.raw

SEQ ID NO: 572391 - DNA, 445 bp, Homo sapiens; identical to SEQ ID NO: 546083
  misc_feature: HIJSMM301AGBIE.5.9.A09.1.454.light.4.raw

SEQ ID NO: 572392 - DNA, 502 bp, Homo sapiens
  misc_feature: HIJSMM301CT2EU.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggcccaaccca

SEQ ID NO: 572393 - DNA, 489 bp, Homo sapiens; identical to SEQ ID NO: 536013
  misc_feature: HIJSMM301CWC1U.26.23.C01.1.454.light.4.raw

SEQ ID NO: 572394 - DNA, 482 bp, Homo sapiens; identical to SEQ ID NO: 536622
  misc_feature: HIJSMM301D9WC3.7.85.H08.1.454.light.4.raw

SEQ ID NO: 572395 - DNA, 501 bp, Homo sapiens
  misc_feature: HIJSMM301E0D3D.53.22.B11.1.454.light.4.raw
  modified_base (107)..(107): a, c, t, g, unknown or other
cgcgtatacacacgaccggtgctcgatttagacgacagctcaggggggtgtctcaccatggcctggatccctctacttctccccctcctcactctctgcacaggctntgaggcctcctatgagctgacacagccaccctcggtgtcagtgtccccacggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattgggccatcagtggagtccaggcagagggacgaggctgactattattgtcaatcaacagacaccattggtacttatgtcttcggactgcgaccaaggtacaccgtcctgggtcgagcccaacggccaacccccacctgtcactctgttcccaccctcctcctcgtacctgcg

SEQ ID NO: 572396 - DNA, 512 bp, Homo sapiens
  misc_feature: HIJSMM301DS2FV.48.35.D02.1.454.light.4.raw
agtatacatacacgaccggtgctcgatttagcacacgatagttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccct

SEQ ID NO: 572397 - DNA, 502 bp, Homo sapiens
  misc_feature: HIJSMM301AZ2GF.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggcctcccaggctcctcatctatgatgcatccaacagggccactggcatcccagacaggttcagtggcaggtgggtctgggacagacttcactctcaccatcagcagcctagagcctgaagtactttggactttattactgtcagcagcgtgagttctggcctccgctcacgtttcggcgggagggaccgagggtggagatacaaaacgaactgtggctgccaccatctgtcttcatt

SEQ ID NO: 572398 - DNA, 496 bp, Homo sapiens
  misc_feature: HIJSMM301AYOMD.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggaggatcaaacgaactagtggctgcaccatctgtcttcatt

SEQ ID NO: 572399 - DNA, 497 bp, Homo sapiens
  misc_feature: HIJSMM301CU05D.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagttgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 572400 - DNA, 447 bp, Homo sapiens; identical to SEQ ID NO: 535201
  misc_feature: HIJSMM301CS4BY.18.9.A09.1.454.light.4.raw

SEQ ID NO: 572401 - DNA, 473 bp, Homo sapiens
  misc_feature: HIJSMM301D0JRY.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgctacgtaga

SEQ ID NO: 572402 - DNA, 516 bp, Homo sapiens
  misc_feature: HIJSMM301AQYTB.27.23.C01.1.454.light.4.raw
  modified_base (513)..(513): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaacagtgacacttgggtgttcggcggagggaccaggctgaccgtctaggtcagcccaaggctgcccctcgtcactctgttcccncct

SEQ ID NO: 572403 - DNA, 487 bp, Homo sapiens; identical to SEQ ID NO: 558317
  misc_feature: HIJSMM301A5VV2.7.85.H08.1.454.light.4.raw

SEQ ID NO: 572404 - DNA, 484 bp, Homo sapiens
  misc_feature: HIJSMM301DECCF.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagatttcacactgaaaatcagccgggtggaggctgaggatgttggggtttattactgcatgcaaagtatacagcttccgtacacttttggccaggggaccaagctggagatcaaacgaactgtggctgcaccatctgtcttcatcttcccgccatctgactagtctacg

SEQ ID NO: 572405 - DNA, 492 bp, Homo sapiens; identical to SEQ ID NO: 537395
  misc_feature: HIJSMM301AN6AR.16.73.G07.1.454.light.4.raw

SEQ ID NO: 572406 - DNA, 494 bp, Homo sapiens; identical to SEQ ID NO: 535828
  misc_feature: HIJSMM301DS8UL.3.36.D03.1.454.light.4.raw

SEQ ID NO: 572407 - DNA, 492 bp, Homo sapiens
  misc_feature: HIJSMM301CGRS4.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtggacgagcagcactgcccgttactgtcttcggaactgggaccaacggtcaccgtcttcgagtcagcccaacgccgaa

SEQ ID NO: 572408 - DNA, 471 bp, Homo sapiens
  misc_feature: HIJSMM301COR6K.4.54.E10.1.454.light.4.raw
agcactgtagcacgaccggtgctcgatttagatcgtagcagaacacacaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtgggtcccatcaaggttcagtggcagtggatctgggacagatttcactctcactgtcagcagtctgcaatttgaagattttgcaacttactactgtcaacagagtttcagtatcccttggactttcggccaagggaccaaggtggaaatcaacgaa

SEQ ID NO: 572409 - DNA, 447 bp, Homo sapiens; identical to SEQ ID NO: 535020
  misc_feature: HIJSMM301C4NQV.18.9.A09.1.454.light.4.raw

SEQ ID NO: 572410 - DNA, 506 bp, Homo sapiens
  misc_feature: HIJSMM301BVUT1.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggagtcaagcgaactgtggctgcaccatctgtcttcatcttcccgcc

SEQ ID NO: 572411 - DNA, 492 bp, Homo sapiens; identical to SEQ ID NO: 540760
  misc_feature: HIJSMM301EDGDY.14.55.E11.1.454.light.4.raw

SEQ ID NO: 572412 - DNA, 516 bp, Homo sapiens
  misc_feature: HIJSMM301AMNP9.48.81.H04.1.454.light.4.raw
  modified_base (493)..(493): a, c, t, g, unknown or other
agtatacatacacgaccggtgctcgatttagtagtgtagattcgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgnaccatctgtcttcatcttccccg

SEQ ID NO: 572413 - DNA, 513 bp, Homo sapiens
  misc_feature: HIJSMM301BGTCA.10.38.D05.1.454.light.4.raw
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttccc

SEQ ID NO: 572414 - DNA, 495 bp, Homo sapiens
  misc_feature: HIJSMM301A0KJM.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgctagtttattactgtcagcagtatgagaagtggttcaagactttcggcggagggaccaaggtggagatcaaacgaactgtggctgcaccatctgtcttcatt

SEQ ID NO: 572415 - DNA, 491 bp, Homo sapiens
  misc_feature: HIJSMM301AHUTL.19.71.G05.1.454.light.4.raw
tactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcaagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtggctgca

SEQ ID NO: 572416 - DNA, 492 bp, Homo sapiens
  misc_feature: HIJSMM301C4RMA.12.38.D05.1.454.light.4.raw
atacgacgtacacgaccggtgctcgatttagtatctgatagttgggtttggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccaaggtggagatcaaacgaactgtggctgcaccatctgtcttcat

SEQ ID NO: 572417 - DNA, 499 bp, Homo sapiens
  misc_feature: HIJSMM301C8SAL.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtcttcatcttccgccat

SEQ ID NO: 572418 - DNA, 487 bp, Homo sapiens
  misc_feature: HIJSMM301DYIHV.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtggtttgggacagagttcactctcaccatcagcagcctgcagtctgaagattttgcagtttattactgtcagcagtatataactggcctcggtcactttcggcggagggaccaaggtggaggatcaaacgaactgtggctgcaccat

SEQ ID NO: 572419 - DNA, 496 bp, Homo sapiens
  misc_feature: HIJSMM301B7Z8V.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggatagatttcactctcaccatcagcagcctgcaggctgaagatgtggcagtttattactgtcagcaatattatattcctcctcagacgttcggccaagggaccaaggtggaaatcaaacgaactgtggctgcacc

SEQ ID NO: 572420 - DNA, 493 bp, Homo sapiens
  misc_feature: HIJSMM301AEXDX.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgtaaagtggggtcccatcaagattcagtggcagtggatctgggacagatttcactctcgccatcagtagtctgcaacctgatgattttgcaacttactactgtcaacagagttccactaccccaactcactttcggtccctcgggacgtcgaagtagcactatagtaagagaaactagtggcgtcgtcacca

SEQ ID NO: 572421 - DNA, 497 bp, Homo sapiens
  misc_feature: HIJSMM301CMM3L.3.33.C11.1.454.light.4.raw
  modified_base (479)..(479): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattaataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccnccctcctcgagtgcgtct

SEQ ID NO: 572422 - DNA, 532 bp, Homo sapiens
  misc_feature: HIJSMM301BZ8BL.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgtacttactattgtcaacagagttaccttctccccggacgttcgcgtacggacgaacggtaggaagtacaacgtacgtaacctaggtggtcgtcgtcgacccaactccttgttcttcctacttcttccccgtccccg

SEQ ID NO: 572423 - DNA, 514 bp, Homo sapiens
  misc_feature: HIJSMM301ENBP1.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaaagcggggacccagaccctggagcctcagttggaagcagccgatccagcctgcggagcctgtggggcaggtcagcccaaggcccaaccccactcgtcactcc

SEQ ID NO: 572424 - DNA, 479 bp, Homo sapiens
  misc_feature: HIJSMM301DYECX.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccaaggtggagatcaaacgaaactgtggctgcacc

SEQ ID NO: 572425 - DNA, 484 bp, Homo sapiens; identical to SEQ ID NO: 552947
  misc_feature: HIJSMM301DCJ6N.40.69.G03.1.454.light.4.raw

SEQ ID NO: 572426 - DNA, 500 bp, Homo sapiens
  misc_feature: HIJSMM301AR9UZ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccgaagggaccaaggtaggagtaatcagacgaactgtggctg

SEQ ID NO: 572427 - DNA, 506 bp, Homo sapiens; identical to SEQ ID NO: 563474
  misc_feature: HIJSMM301BGVKD.10.27.C05.1.454.light.4.raw

SEQ ID NO: 572428 - DNA, 517 bp, Homo sapiens; identical to SEQ ID NO: 536980
  misc_feature: HIJSMM301BUMBB.5.27.C05.1.454.light.4.raw

SEQ ID NO: 572429 - DNA, 481 bp, Homo sapiens
  misc_feature: HIJSMM301EWGEA.51.28.C06.1.454.light.4.raw
cgatcgtatacacgaccggtgctcgatttagagctcacgtattgggtttggggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcgggggaccgaaggtggagatcaagcgaactgtggctgcaccatctgtt

SEQ ID NO: 572430 - DNA, 476 bp, Homo sapiens; identical to SEQ ID NO: 549229
  misc_feature: HIJSMM301BFVQR.12.1.A01.1.454.light.4.raw

SEQ ID NO: 572431 - DNA, 496 bp, Homo sapiens
  misc_feature: HIJSMM301COXB2.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaaacagacaccattggtacttatgtcttcggaactgcgaccaaggtcaccgtcctgggtcagcccaaggccaacccactgtcactctcg

SEQ ID NO: 572432 - DNA, 522 bp, Homo sapiens; identical to SEQ ID NO: 543470
  misc_feature: HIJSMM301DOXVY.5.27.C05.1.454.light.4.raw

SEQ ID NO: 572433 - DNA, 491 bp, Homo sapiens; identical to SEQ ID NO: 536211
  misc_feature: HIJSMM301DVGP7.16.53.E09.1.454.light.4.raw

SEQ ID NO: 572434 - DNA, 499 bp, Homo sapiens; identical to SEQ ID NO: 541506
  misc_feature: HIJSMM301AN1W1.51.38.D05.1.454.light.4.raw

SEQ ID NO: 572435 - DNA, 466 bp, Homo sapiens
  misc_feature: HIJSMM301CYW0Q.51.8.A08.1.454.light.4.raw
cgatcgtatacacgaccggtgctcgatttagcatactctacagggggtgcaggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatctaggttcagcggcagtggatctgggacagaattcactctcacaatcagcagcctgcagcctgaagattttgcaacttattactgtcaacagcacacttttggccaggggaccaagctggagatcaaacgaactgtggctgcacc

SEQ ID NO: 572436 - DNA, 490 bp, Homo sapiens; identical to SEQ ID NO: 535234
  misc_feature: HIJSMM301B51LE.17.21.B10.1.454.light.4.raw

SEQ ID NO: 572437 - DNA, 473 bp, Homo sapiens; identical to SEQ ID NO: 546369
  misc_feature: HIJSMM301EC7TS.18.76.G10.1.454.light.4.raw

SEQ ID NO: 572438 - DNA, 487 bp, Homo sapiens; identical to SEQ ID NO: 536536
  misc_feature: HIJSMM301BAA4D.26.45.E01.1.454.light.4.raw

SEQ ID NO: 572439 - DNA, 499 bp, Homo sapiens
  misc_feature: HIJSMM301CNEY6.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttcaatcgcttctctggctccaagtctggcgacacggcctccctgaccatctctgggctccaggctgaaggacgaggctgattattactgcagctcatatacaggcagcagcactcaggttttcggccggagggaccaagctgaccgtcctaggtcagcccaaggctgccccctcggt

SEQ ID NO: 572440 - DNA, 506 bp, Homo sapiens; identical to SEQ ID NO: 540748
  misc_feature: HIJSMM301EVFOJ.18.37.D04.1.454.light.4.raw

SEQ ID NO: 572441 - DNA, 497 bp, Homo sapiens
  misc_feature: HIJSMM301AJRP0.11.10.A10.1.454.light.4.raw
  modified_base (476)..(476): a, c, t, g, unknown or other
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccgaacggaccgaaggtggaagtcaaacgaactagtggctgcnccatctgtcttcatcttcccg

SEQ ID NO: 572442 - DNA, 449 bp, Homo sapiens
  misc_feature: HIJSMM301D2P6Q.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctagcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttccccaccctcctccatactcgta

SEQ ID NO: 572443 - DNA, 501 bp, Homo sapiens; identical to SEQ ID NO: 536142
  misc_feature: HIJSMM301D5UT2.15.1.A01.1.454.light.4.raw

SEQ ID NO: 572444 - DNA, 496 bp, Homo sapiens; identical to SEQ ID NO: 535556
  misc_feature: HIJSMM301BXXPR.26.80.H03.1.454.light.4.raw

SEQ ID NO: 572445 - DNA, 515 bp, Homo sapiens
  misc_feature: HIJSMM301EA851.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcc

SEQ ID NO: 572446 - DNA, 494 bp, Homo sapiens; identical to SEQ ID NO: 534992
  misc_feature: HIJSMM301DIK4S.9.1.A01.1.454.light.4.raw

SEQ ID NO: 572447 - DNA, 416 bp, Homo sapiens; identical to SEQ ID NO: 535308
  misc_feature: HIJSMM301EH9CL.16.46.E02.1.454.light.4.raw

SEQ ID NO: 572448 - DNA, 479 bp, Homo sapiens
  misc_feature: HIJSMM301ANT6Z.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccaaggtaggaaatcaaacgaactacgtggctgca

SEQ ID NO: 572449 - DNA, 486 bp, Homo sapiens
  misc_feature: HIJSMM301DT6GS.51.6.A06.1.454.light.4.raw
cgatcgtatacacgaccggtgctcgatttagatctactgacaggggcctggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcacgtcctaggtcacg

SEQ ID NO: 572450 - DNA, 503 bp, Homo sapiens
  misc_feature: HIJSMM301DSTHL.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaagtggaggatcaaacgaactgtggctgcaccta

SEQ ID NO: 572451 - DNA, 502 bp, Homo sapiens
  misc_feature: HIJSMM301EZF4Q.40.45.E01.1.454.light.4.raw
tctagcgactcacgaccggtgctcgatttagtgagtcagtaagggaaagggggaggaactgctcagttaggacccagagggaaccatggaagccccagctcagcttctcttcctcctgctactctggctcccagtaatcaccggagaaattgtgttgacacagtctccagccaccctgtccttctctccaggggaaagagcctccctctcctgcagggccagtcagagtattaataccttcttggcctggtaccagcaaaagcctggccaggctcccagactcctcatctatgatgcatccaacagggccactggcgtcccggccaggttcagtggcagtgggtctgggacagacttcactctcaccatcagcagcctagagcctgaagatttagcagtttattactgtcagcagcgtgccaactggcctctcactttcggcggagggaccaaggtggagatcaaacgaactgtggctgcaccatctgtcttcatcttcccg

SEQ ID NO: 572452 - DNA, 504 bp, Homo sapiens
  misc_feature: HIJSMM301CVYOB.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttggtccaggggaccgaagctgaggatcaaacgaaactgtggctgcaccta

SEQ ID NO: 572453 - DNA, 524 bp, Homo sapiens
  misc_feature: HIJSMM301AP4WU.27.23.C01.1.454.light.4.raw
  modified_base (507)..(507): a, c, t, g, unknown or other
agcgtcgtctcacgaccggtgctcgatttagtacacgtgattagggattggggggggtcgtcaggagggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtnacctctgttcccaccct

SEQ ID NO: 572454 - DNA, 501 bp, Homo sapiens; identical to SEQ ID NO: 536142
  misc_feature: HIJSMM301D348Y.15.1.A01.1.454.light.4.raw

SEQ ID NO: 572455 - DNA, 486 bp, Homo sapiens
  misc_feature: HIJSMM301CI9HY.43.36.D03.1.454.light.4.raw
  modified_base (308)..(308): a, c, t, g, unknown or other
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatcccccaccatcagcacgccttagcctggtaccagcacaagtcagggcagcctcctaagttgctcttttacnggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaaggttggagatcaaacgaa

SEQ ID NO: 572456 - DNA, 494 bp, Homo sapiens
  misc_feature: HIJSMM301BQANL.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacaggatttcactctcaccatcagcagcctgcaggctgaagatgtggcagtttattactgtcagcaatattatagtactcctccgaggctcactttcggcggtagggaccaaggtggaggatcaaacgaactgtgg

SEQ ID NO: 572457 - DNA, 483 bp, Homo sapiens; identical to SEQ ID NO: 547838
  misc_feature: HIJSMM301DL5ZL.46.26.C04.1.454.light.4.raw

SEQ ID NO: 572458 - DNA, 492 bp, Homo sapiens
  misc_feature: HIJSMM301CFH9G.47.38.D05.1.454.light.4.raw
agctcacgtacacgaccggtgctcgatttagtatctgatagttgggtttgggggaccgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccagggaccaagctggagatcaaacgaactgtgg

SEQ ID NO: 572459 - DNA, 493 bp, Homo sapiens; identical to SEQ ID NO: 535084
  misc_feature: HIJSMM301BG66V.47.64.F09.1.454.light.4.raw

SEQ ID NO: 572460 - DNA, 495 bp, Homo sapiens; identical to SEQ ID NO: 544003
  misc_feature: HIJSMM301AXVNM.3.31.C09.1.454.light.4.raw

SEQ ID NO: 572461 - DNA, 489 bp, Homo sapiens; identical to SEQ ID NO: 535139
  misc_feature: HIJSMM301DL4KS.14.55.E11.1.454.light.4.raw

SEQ ID NO: 572462 - DNA, 460 bp, Homo sapiens; identical to SEQ ID NO: 537107
  misc_feature: HIJSMM301BZUH7.22.28.C06.1.454.light.4.raw

SEQ ID NO: 572463 - DNA, 483 bp, Homo sapiens
  misc_feature: HIJSMM301D0TS7.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctaaagtggatgaggctgacttttactgtcaggcgtgggacagcgacactgccgtgttcggcggagggaccaagctgaccgtcctcggtcagcccaaggctcg

SEQ ID NO: 572464 - DNA, 490 bp, Homo sapiens; identical to SEQ ID NO: 535526
  misc_feature: HIJSMM301A8JH5.26.78.H01.1.454.light.4.raw

SEQ ID NO: 572465 - DNA, 486 bp, Homo sapiens
  misc_feature: HIJSMM301BOEAY.41.33.C11.1.454.light.4.raw
tctatactatcacgaccggtgctcgatttagagtgagctcgttgggtttgggggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaagtggatttcaaacgaactgtggctgcaccat

SEQ ID NO: 572466 - DNA, 478 bp, Homo sapiens; identical to SEQ ID NO: 535129
  misc_feature: HIJSMM301A0JR9.11.11.A11.1.454.light.4.raw

SEQ ID NO: 572467 - DNA, 508 bp, Homo sapiens; identical to SEQ ID NO: 552440
  misc_feature: HIJSMM301B1QSX.5.24.C02.1.454.light.4.raw

SEQ ID NO: 572468 - DNA, 518 bp, Homo sapiens; identical to SEQ ID NO: 548899
  misc_feature: HIJSMM301EJ6E4.41.25.C03.1.454.light.4.raw

SEQ ID NO: 572469 - DNA, 462 bp, Homo sapiens; identical to SEQ ID NO: 542244
  misc_feature: HIJSMM301DP6U2.49.73.G07.1.454.light.4.raw

SEQ ID NO: 572470 - DNA, 504 bp, Homo sapiens
  misc_feature: HIJSMM301ANW1W.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccca

SEQ ID NO: 572471 - DNA, 512 bp, Homo sapiens
  misc_feature: HIJSMM301DIK7T.17.33.C11.1.454.light.4.raw
  modified_base (505)..(505): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccnccctcct

SEQ ID NO: 572472 - DNA, 444 bp, Homo sapiens; identical to SEQ ID NO: 539971
  misc_feature: HIJSMM301CCCXD.8.73.G07.1.454.light.4.raw
  modified_base (426)..(426): a, c, t, g, unknown or other

SEQ ID NO: 572473 - DNA, 503 bp, Homo sapiens
  misc_feature: HIJSMM301ASLTA.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcgccgaaggacacgactggagattaaaacg

SEQ ID NO: 572474 - DNA, 503 bp, Homo sapiens; identical to SEQ ID NO: 538583
  misc_feature: HIJSMM301AXN1O.15.59.F04.1.454.light.4.raw

SEQ ID NO: 572475 - DNA, 494 bp, Homo sapiens; identical to SEQ ID NO: 539894
  misc_feature: HIJSMM301DNBX0.16.53.E09.1.454.light.4.raw

SEQ ID NO: 572476 - DNA, 520 bp, Homo sapiens
  misc_feature: HIJSMM301C59EL.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccaagtgacacttggtgttcggcggagggaccaggctgaccgtcctaggtcagcccaaggctgccccctcggtcactctgttcccgcct

SEQ ID NO: 572477 - DNA, 492 bp, Homo sapiens; identical to SEQ ID NO: 535126
  misc_feature: HIJSMM301EH5BP.18.11.A11.1.454.light.4.raw

SEQ ID NO: 572478 - DNA, 497 bp, Homo sapiens
  misc_feature: HIJSMM301BR57Q.18.59.F04.1.454.light.4.raw
  modified_base (365)..(365): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacncggcctccctgaccatctctggactccaggctgaggacgaggctgattattactgcagctcatatacaagcaccagcactctctatgtcttcggaactgggaccaaggtcaccgtcctaggtcagcccaagg

SEQ ID NO: 572479 - DNA, 456 bp, Homo sapiens
  misc_feature: HIJSMM301B1R5P.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtccgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccagtactcgta

SEQ ID NO: 572480 - DNA, 503 bp, Homo sapiens
  misc_feature: HIJSMM301C87WG.43.57.F02.1.454.light.4.raw
tgtgagtagtcacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgccccctcggt

SEQ ID NO: 572481 - DNA, 493 bp, Homo sapiens; identical to SEQ ID NO: 535084
  misc_feature: HIJSMM301DF1RQ.47.64.F09.1.454.light.4.raw

SEQ ID NO: 572482 - DNA, 461 bp, Homo sapiens; identical to SEQ ID NO: 551628
  misc_feature: HIJSMM301DJROT.15.11.A11.1.454.light.4.raw

SEQ ID NO: 572483 - DNA, 487 bp, Homo sapiens
  misc_feature: HIJSMM301CDD8F.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccccaagaacttttggccaggggaccaagctggagatcaaacgaactgtggctgcaccat

SEQ ID NO: 572484 - DNA, 521 bp, Homo sapiens
  misc_feature: HIJSMM301BAMZO.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttggggcaaagctgccctgacactgtcaggtgtgcaccctgaggacgaggctgagtattactgtctgctccactttcgtactgcctgggtcttcggcgggggacgtcagttgaccgtcctaggtcagcccaacggctcgccccctccggtcactctcgttcccgccctcctcacta

SEQ ID NO: 572485 - DNA, 494 bp, Homo sapiens; identical to SEQ ID NO: 534994
  misc_feature: HIJSMM301EZ318.27.78.H01.1.454.light.4.raw

SEQ ID NO: 572486 - DNA, 494 bp, Homo sapiens; identical to SEQ ID NO: 534992
  misc_feature: HIJSMM301DPY25.9.1.A01.1.454.light.4.raw

SEQ ID NO: 572487 - DNA, 492 bp, Homo sapiens
  misc_feature: HIJSMM301BKFW4.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgatgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtt

SEQ ID NO: 572488 - DNA, 440 bp, Homo sapiens
  misc_feature: HIJSMM301DCLXG.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcatagtataa

SEQ ID NO: 572489 - DNA, 483 bp, Homo sapiens
  misc_feature: HIJSMM301DGU6Y.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcgtccgaaggaccgaaggtaggaaagtacaaacgaacagtgctgcacca

SEQ ID NO: 572490 - DNA, 504 bp, Homo sapiens; identical to SEQ ID NO: 535077
  misc_feature: HIJSMM301B5XG8.8.28.C06.1.454.light.4.raw

SEQ ID NO: 572491 - DNA, 520 bp, Homo sapiens
  misc_feature: HIJSMM301BW45T.7.5.A05.1.454.light.4.raw
  modified_base (313)..(313): a, c, t, g, unknown or other
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttnaggggtttccaactcgcttctctggctccaagtctggcgacacggcctccctgaccatctctgggctccaggctgaagacgaggctgattattactgcagctcatattacaggcagcagactactcgttaggtttcggcgggacggaaccgaacgcgtcgtccgtacgtcgtacgaccgaccgaaggtcgtcccgtccccgtccggt

SEQ ID NO: 572492 - DNA, 470 bp, Homo sapiens
  misc_feature: HIJSMM301D1VJI.3.1.A01.1.454.light.4.raw
  modified_base (448)..(448): a, c, t, g, unknown or other
  modified_base (458)..(458): a, c, t, g, unknown or other
agacgcactccacgaccggtgctcgatttagacgtctcatcaggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattgacgttggccaaggaccaagatagaaatnaaacgaaacntggctgcaccat

SEQ ID NO: 572493 - DNA, 514 bp, Homo sapiens
  misc_feature: HIJSMM301CC4BO.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccgccctcctcgagtagtaca

SEQ ID NO: 572494 - DNA, 495 bp, Homo sapiens; identical to SEQ ID NO: 536931
  misc_feature: HIJSMM301CK3KX.10.33.C11.1.454.light.4.raw

SEQ ID NO: 572495 - DNA, 502 bp, Homo sapiens
  misc_feature: HIJSMM301A0HNQ.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtctgggtcagcccaaggctgccccctcggtca

SEQ ID NO: 572496 - DNA, 502 bp, Homo sapiens
  misc_feature: HIJSMM301CL8AA.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttttactgtcagcagtatagtaactggccctcgtactactttcggccgacgggaccaagactaagaaactacaaacgaactgtggctgccacactctcgtcttcta

SEQ ID NO: 572497 - DNA, 454 bp, Homo sapiens; identical to SEQ ID NO: 534964
  misc_feature: HIJSMM301DT4FU.19.86.H09.1.454.light.4.raw

SEQ ID NO: 572498 - DNA, 523 bp, Homo sapiens
  misc_feature: HIJSMM301B15O7.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccggggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 572499 - DNA, 485 bp, Homo sapiens; identical to SEQ ID NO: 536210
  misc_feature: HIJSMM301CAOSK.43.54.E10.1.454.light.4.raw

SEQ ID NO: 572500 - DNA, 486 bp, Homo sapiens
  misc_feature: HIJSMM301BIQ0N.3.46.E02.1.454.light.4.raw
agacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagattttgcagtttatttctgttcagcagtttaacacctggcctggaagttttggccaggggaccaagctggagctcaaacgaactgtggctgcaccat

SEQ ID NO: 572501 - DNA, 517 bp, Homo sapiens
  misc_feature: HIJSMM301DMNQK.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaaacagagttttcagtgtccccccgggacgttcggccacgggaccgaccgagtagaaaatagaagacgaaactagtggctgcgaccatctgttcttctactcttcccgt

SEQ ID NO: 572502 - DNA, 482 bp, Homo sapiens; identical to SEQ ID NO: 540658
  misc_feature: HIJSMM301A94LI.16.81.H04.1.454.light.4.raw

SEQ ID NO: 572503 - DNA, 484 bp, Homo sapiens
  misc_feature: HIJSMM301ASAFU.48.84.H07.1.454.light.4.raw
agtatacatacacgaccggtgctcgatttagcagacgtctgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctacggtcacg

SEQ ID NO: 572504 - DNA, 500 bp, Homo sapiens; identical to SEQ ID NO: 535310
  misc_feature: HIJSMM301BOT50.47.66.F11.1.454.light.4.raw

SEQ ID NO: 572505 - DNA, 504 bp, Homo sapiens; identical to SEQ ID NO: 540689
  misc_feature: HIJSMM301DD50R.21.38.D05.1.454.light.4.raw

SEQ ID NO: 572506 - DNA, 520 bp, Homo sapiens; identical to SEQ ID NO: 537173
  misc_feature: HIJSMM301AXQE5.27.23.C01.1.454.light.4.raw

SEQ ID NO: 572507 - DNA, 497 bp, Homo sapiens; identical to SEQ ID NO: 536371
  misc_feature: HIJSMM301CKVY2.16.78.H01.1.454.light.4.raw

SEQ ID NO: 572508 - DNA, 510 bp, Homo sapiens
  misc_feature: HIJSMM301CDM31.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccgcct

SEQ ID NO: 572509 - DNA, 497 bp, Homo sapiens; identical to SEQ ID NO: 536371
  misc_feature: HIJSMM301B6URY.16.78.H01.1.454.light.4.raw

SEQ ID NO: 572510 - DNA, 507 bp, Homo sapiens
  misc_feature: HIJSMM301D7W7V.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctcctgaccgtctctgggctccaggctgaggatgaggctgattattactgcagctcatatgcaggcagcagcagtccccatgtgatcttcggcggggggaccaaggctgaccgtcctaggtcagcccaaggctgccccccg

SEQ ID NO: 572511 - DNA, 507 bp, Homo sapiens
  misc_feature: HIJSMM301C7TQ4.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggagggaccaaacgtgaccgtcctagggtccaggcccaa

SEQ ID NO: 572512 - DNA, 471 bp, Homo sapiens
  misc_feature: HIJSMM301EFZCE.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctaggaattttgcaacttactattgtcaacaggctgacagtctcccgctcactttcggcggagggaccaaggtggagatcaaacgaactgtgg

SEQ ID NO: 572513 - DNA, 503 bp, Homo sapiens
  misc_feature: HIJSMM301B9LOI.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaacgaactgtggctgcacatctgtctt

SEQ ID NO: 572514 - DNA, 488 bp, Homo sapiens; identical to SEQ ID NO: 540827
  misc_feature: HIJSMM301D23OM.15.49.E05.1.454.light.4.raw

SEQ ID NO: 572515 - DNA, 486 bp, Homo sapiens; identical to SEQ ID NO: 535043
  misc_feature: HIJSMM301EGNJY.46.35.D02.1.454.light.4.raw

SEQ ID NO: 572516 - DNA, 494 bp, Homo sapiens; identical to SEQ ID NO: 537418
  misc_feature: HIJSMM301BOZUU.9.1.A01.1.454.light.4.raw

SEQ ID NO: 572517 - DNA, 512 bp, Homo sapiens; identical to SEQ ID NO: 542788
  misc_feature: HIJSMM301ADW1B.17.33.C11.1.454.light.4.raw

SEQ ID NO: 572518 - DNA, 522 bp, Homo sapiens
  misc_feature: HIJSMM301EP6CW.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagggctgaccgtcctaggtcagcccaaggctgccccctcggtcactctgttcccaccct

SEQ ID NO: 572519 - DNA, 487 bp, Homo sapiens
  misc_feature: HIJSMM301A88Q4.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 572520 - DNA, 504 bp, Homo sapiens; identical to SEQ ID NO: 549538
  misc_feature: HIJSMM301DM7A9.18.59.F04.1.454.light.4.raw

SEQ ID NO: 572521 - DNA, 482 bp, Homo sapiens; identical to SEQ ID NO: 535216
  misc_feature: HIJSMM301ARLZ4.17.26.C04.1.454.light.4.raw

SEQ ID NO: 572522 - DNA, 453 bp, Homo sapiens
  misc_feature: HIJSMM301BZX8M.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaaggctgaccgtcctaagtcagcgcaaggctgccccctggtcactctgttcccgcctcctccacgagagta

SEQ ID NO: 572523 - DNA, 495 bp, Homo sapiens
  misc_feature: HIJSMM301BQU6M.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactaggagattaaacgaactgtggctgcaccatctgtctt

SEQ ID NO: 572524 - DNA, 501 bp, Homo sapiens; identical to SEQ ID NO: 535746
  misc_feature: HIJSMM301BI8RP.18.11.A11.1.454.light.4.raw

SEQ ID NO: 572525 - DNA, 486 bp, Homo sapiens; identical to SEQ ID NO: 548935
  misc_feature: HIJSMM301AVEOT.47.38.D05.1.454.light.4.raw

SEQ ID NO: 572526 - DNA, 503 bp, Homo sapiens
  misc_feature: HIJSMM301DNNR5.51.23.C01.1.454.light.4.raw
cgatcgtatacacgaccggtgctcgatttagtacacgtgattagggattggggggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttccccgccat

SEQ ID NO: 572527 - DNA, 508 bp, Homo sapiens
  misc_feature: HIJSMM301DT7TV.49.16.B05.1.454.light.4.raw
agtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattattgtcaatcaacagacaccattggtacttatgtcttcggaactgcgaccaaggtcaccgtcctgggtcagcccaaggccaaccccactgtcactctgttcccgcctcctctct

SEQ ID NO: 572528 - DNA, 503 bp, Homo sapiens
  misc_feature: HIJSMM301E11ZK.47.55.E11.1.454.light.4.raw
agctcacgtacacgaccggtgctcgatttagcactcgcacgtagggtcttgggcccagtctgtgctgactcagccaccctcagcgtctgggaccccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaacccactgtcactctgttcccaccctcctcta

SEQ ID NO: 572529 - DNA, 478 bp, Homo sapiens; identical to SEQ ID NO: 535129
  misc_feature: HIJSMM301CCI5I.11.11.A11.1.454.light.4.raw

SEQ ID NO: 572530 - DNA, 489 bp, Homo sapiens; identical to SEQ ID NO: 543840
  misc_feature: HIJSMM301CYK5G.12.88.H11.1.454.light.4.raw

SEQ ID NO: 572531 - DNA, 489 bp, Homo sapiens
  misc_feature: HIJSMM301CU9T2.14.55.E11.1.454.light.4.raw
  modified_base (468)..(468): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcgagggaccaaggcggagatcagacgaactgnggctgcaccatctgtcttcta

SEQ ID NO: 572532 - DNA, 484 bp, Homo sapiens; identical to SEQ ID NO: 549648
  misc_feature: HIJSMM301DGWOW.43.36.D03.1.454.light.4.raw

SEQ ID NO: 572533 - DNA, 511 bp, Homo sapiens
  misc_feature: HIJSMM301AO7Z7.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacaacaaaatacagcctctctgaccattactggtctccagcctgacgacgaggctgactactactgctcagccgtgggacaccagcctcgctgcttggtcttttcggcggacgggaccaagctgaccgtcctggtcacgcccaaggctcgcccccgtcggtcta

SEQ ID NO: 572534 - DNA, 489 bp, Homo sapiens
  misc_feature: HIJSMM301CS2S7.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttacccgtcctaggtcagaccccg

SEQ ID NO: 572535 - DNA, 526 bp, Homo sapiens
  misc_feature: HIJSMM301AMI0Z.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacgggaaccgaacggtaggaaggtacgtaaacgaacgtacgtaggtcgtgcaccactctgtcttctactcttcccgtcccact

SEQ ID NO: 572536 - DNA, 503 bp, Homo sapiens; identical to SEQ ID NO: 571736
  misc_feature: HIJSMM301DTXIH.21.22.B11.1.454.light.4.raw

SEQ ID NO: 572537 - DNA, 480 bp, Homo sapiens; identical to SEQ ID NO: 535630
  misc_feature: HIJSMM301CNJOX.40.59.F04.1.454.light.4.raw

SEQ ID NO: 572538 - DNA, 521 bp, Homo sapiens; identical to SEQ ID NO: 539470
  misc_feature: HIJSMM301BIM3J.27.23.C01.1.454.light.4.raw

SEQ ID NO: 572539 - DNA, 491 bp, Homo sapiens; identical to SEQ ID NO: 535176
  misc_feature: HIJSMM301CKCE3.13.39.D06.1.454.light.4.raw

SEQ ID NO: 572540 - DNA, 522 bp, Homo sapiens; identical to SEQ ID NO: 538091
  misc_feature: HIJSMM301DG94E.27.23.C01.1.454.light.4.raw

SEQ ID NO: 572541 - DNA, 495 bp, Homo sapiens
  misc_feature: HIJSMM301BOFUI.52.86.H09.1.454.light.4.raw
cgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcaccaaggtcaccgtctgggtcagcccaaggccaaccccactcgta

SEQ ID NO: 572542 - DNA, 504 bp, Homo sapiens
  misc_feature: HIJSMM301DKWWU.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggcccaagggacacgactggagattaaacg

SEQ ID NO: 572543 - DNA, 523 bp, Homo sapiens
  misc_feature: HIJSMM301EXYXL.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgagggctgattattattgtagttcatatacaaccagtgacacttgggtgttcggcggagggaccaggctgaccgtcctaggtcagcccaaggctcgccccctcgtctactctcgtcccaccct

SEQ ID NO: 572544 - DNA, 500 bp, Homo sapiens
  misc_feature: HIJSMM301BCXXJ.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaacgaactgtggctgcaccatctgtcttcatt

SEQ ID NO: 572545 - DNA, 493 bp, Homo sapiens; identical to SEQ ID NO: 539456
  misc_feature: HIJSMM301CIFAT.10.79.H02.1.454.light.4.raw

SEQ ID NO: 572546 - DNA, 474 bp, Homo sapiens
  misc_feature: HIJSMM301CN5BF.52.43.D10.1.454.light.4.raw
  modified_base (456)..(456): a, c, t, g, unknown or other
  modified_base (465)..(465): a, c, t, g, unknown or other
  modified_base (468)..(468): a, c, t, g, unknown or other
cgcagtacgacacgaccggtgctcgatttagactagcagtaagggggaggaactgctcagttaggacccagacggaaccatggaagccccagcgcagcttctcttcctcctgctactctggctcccagattctactgaagaaatagtgatgacgcagtctccagccaccctgtctgtgtctccaggggaagcagtcaccctctcctgcagggccagtcagactgttaacaccaacttagcctggtaccagcacaaacctggccgggctcccaggctcctcatctatggtgcatccaccagggccactggtgtcccagccaggttcagtggcagtgggtctgggacagagttcactctcaccatcagcagcctgcagtctgaagattttgcagtttattactgtcagcatatcataactggtctcttcacttgtccgcgtcgacgaggagtatatanaactatagngtntgcact

SEQ ID NO: 572547 - DNA, 493 bp, Homo sapiens; identical to SEQ ID NO: 535745
  misc_feature: HIJSMM301D5ESG.47.78.H01.1.454.light.4.raw

SEQ ID NO: 572548 - DNA, 480 bp, Homo sapiens
  misc_feature: HIJSMM301ENVXO.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggtaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagttcactacccctctcactttcggcgggggaccgaaggtggagatcaaacgaactgtggctgcac

SEQ ID NO: 572549 - DNA, 521 bp, Homo sapiens; identical to SEQ ID NO: 536990
  misc_feature: HIJSMM301AZFKT.27.23.C01.1.454.light.4.raw
  modified_base (517)..(517): a, c, t, g, unknown or other

SEQ ID NO: 572550 - DNA, 491 bp, Homo sapiens
  misc_feature: HIJSMM301EN2PT.48.78.H01.1.454.light.4.raw
agtatacatacacgaccggtgctcgatttagtgtgagtagtttgggtttggggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcagccc

SEQ ID NO: 572551 - DNA, 503 bp, Homo sapiens; identical to SEQ ID NO: 540136
  misc_feature: HIJSMM301DV6O8.19.10.A10.1.454.light.4.raw

SEQ ID NO: 572552 - DNA, 479 bp, Homo sapiens
  misc_feature: HIJSMM301EPK7V.4.39.D06.1.454.light.4.raw
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccgagggaccaaggtcgaaatgagacgaactgtggctgcaccatct

SEQ ID NO: 572553 - DNA, 513 bp, Homo sapiens
  misc_feature: HIJSMM301A0R72.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgtctgttcatttttctaagtttcccttttttgttctttcggaactgggaccgaggtcaccgtcctaggtcagcccaaggcccaaccccactgtcta

SEQ ID NO: 572554 - DNA, 488 bp, Homo sapiens; identical to SEQ ID NO: 537357
  misc_feature: HIJSMM301C4OPH.19.71.G05.1.454.light.4.raw

SEQ ID NO: 572555 - DNA, 463 bp, Homo sapiens; identical to SEQ ID NO: 543051
  misc_feature: HIJSMM301C3Q2W.26.78.H01.1.454.light.4.raw

SEQ ID NO: 572556 - DNA, 474 bp, Homo sapiens
  misc_feature: HIJSMM301BPDAG.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagcactttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagattttgcaacttactactgtcaacagagttttcagtatcccttggactttcggccaagggaccaaggtaggaaatcaaacgaa

SEQ ID NO: 572557 - DNA, 523 bp, Homo sapiens
  misc_feature: HIJSMM301CUX0F.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggccccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccctcct

SEQ ID NO: 572558 - DNA, 493 bp, Homo sapiens; identical to SEQ ID NO: 536246
  misc_feature: HIJSMM301BMPQC.49.66.F11.1.454.light.4.raw

SEQ ID NO: 572559 - DNA, 493 bp, Homo sapiens; identical to SEQ ID NO: 537422
  misc_feature: HIJSMM301E0HM9.9.34.D01.1.454.light.4.raw

SEQ ID NO: 572560 - DNA, 503 bp, Homo sapiens; identical to SEQ ID NO: 551625
  misc_feature: HIJSMM301CEPTF.10.71.G05.1.454.light.4.raw

SEQ ID NO: 572561 - DNA, 494 bp, Homo sapiens; identical to SEQ ID NO: 535478
  misc_feature: HIJSMM301B54LK.10.79.H02.1.454.light.4.raw

SEQ ID NO: 572562 - DNA, 441 bp, Homo sapiens
  misc_feature: HIJSMM301EL3GQ.8.4.A04.1.454.light.4.raw
ctcgcgtgtccacgaccggtgctcgatttagagtagtgatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaccaagctgaccgtcctaggtcagcccaaggctgccccctggtcactctgttccccaccctcctcgacacgcgag

SEQ ID NO: 572563 - DNA, 485 bp, Homo sapiens; identical to SEQ ID NO: 535985
  misc_feature: HIJSMM301AWGR0.15.1.A01.1.454.light.4.raw

SEQ ID NO: 572564 - DNA, 484 bp, Homo sapiens; identical to SEQ ID NO: 538247
  misc_feature: HIJSMM301D659P.14.53.E09.1.454.light.4.raw

SEQ ID NO: 572565 - DNA, 484 bp, Homo sapiens; identical to SEQ ID NO: 535211
  misc_feature: HIJSMM301AYPCS.47.46.E02.1.454.light.4.raw

SEQ ID NO: 572566 - DNA, 487 bp, Homo sapiens
  misc_feature: HIJSMM301ASSD9.49.46.E02.1.454.light.4.raw
agtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatct

SEQ ID NO: 572567 - DNA, 475 bp, Homo sapiens; identical to SEQ ID NO: 550613
  misc_feature: HIJSMM301BS5WZ.43.76.G10.1.454.light.4.raw

SEQ ID NO: 572568 - DNA, 488 bp, Homo sapiens
  misc_feature: HIJSMM301BZV77.41.2.A02.1.454.light.4.raw
tctatactatcacgaccggtgctcgatttagactcatctacaggggagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctccccttagtttcggcggagggaccaaggttgagatcaaacgaactgtggctgcaccatctgtcttcatcttcccg

SEQ ID NO: 572569 - DNA, 505 bp, Homo sapiens
  misc_feature: HIJSMM301C4D1K.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgtcgtccgacggaccgaacggtaggaaggtacgaaacgaaacctaagttggcgtgcaccaactctcgtctt

SEQ ID NO: 572570 - DNA, 492 bp, Homo sapiens
  misc_feature: HIJSMM301D49RR.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatcttcg

SEQ ID NO: 572571 - DNA, 487 bp, Homo sapiens; identical to SEQ ID NO: 536206
  misc_feature: HIJSMM301BLP88.47.38.D05.1.454.light.4.raw

SEQ ID NO: 572572 - DNA, 475 bp, Homo sapiens
  misc_feature: HIJSMM301B1MGU.11.76.G10.1.454.light.4.raw
cgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggcctaggggaccaggctggagat

SEQ ID NO: 572573 - DNA, 490 bp, Homo sapiens; identical to SEQ ID NO: 543909
  misc_feature: HIJSMM301CZLFI.14.55.E11.1.454.light.4.raw

SEQ ID NO: 572574 - DNA, 477 bp, Homo sapiens
  misc_feature: HIJSMM301B8OJR.41.8.A08.1.454.light.4.raw
tctatactatcacgaccggtgctcgatttagcatactctacaggggggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagcttttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgaactgtggctgcacc

SEQ ID NO: 572575 - DNA, 486 bp, Homo sapiens
  misc_feature: HIJSMM301A86DR.41.44.D11.1.454.light.4.raw
tctatactatcacgaccggtgctcgatttagcgcagtacgaatggggcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagcccaagg

SEQ ID NO: 572576 - DNA, 503 bp, Homo sapiens; identical to SEQ ID NO: 544567
  misc_feature: HIJSMM301DK6P1.41.35.D02.1.454.light.4.raw

SEQ ID NO: 572577 - DNA, 510 bp, Homo sapiens; identical to SEQ ID NO: 535855
  misc_feature: HIJSMM301C7P5W.17.33.C11.1.454.light.4.raw

SEQ ID NO: 572578 - DNA, 505 bp, Homo sapiens; identical to SEQ ID NO: 542754
  misc_feature: HIJSMM301AQFT8.4.57.F02.1.454.light.4.raw

SEQ ID NO: 572579 - DNA, 486 bp, Homo sapiens; identical to SEQ ID NO: 535043
  misc_feature: HIJSMM301EMC7N.46.35.D02.1.454.light.4.raw

SEQ ID NO: 572580 - DNA, 496 bp, Homo sapiens
  misc_feature: HIJSMM301AFVYS.49.17.B06.1.454.light.4.raw
agtcgagagacacgaccggtgctcgatttagtcgatagtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcggggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcactctcg

SEQ ID NO: 572581 - DNA, 486 bp, Homo sapiens; identical to SEQ ID NO: 536323
  misc_feature: HIJSMM301DWWJF.10.2.A02.1.454.light.4.raw

SEQ ID NO: 572582 - DNA, 498 bp, Homo sapiens
  misc_feature: HIJSMM301EOP9P.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaaacgaactgtggctgcaccatctgtctcatcttcccg

SEQ ID NO: 572583 - DNA, 448 bp, Homo sapiens; identical to SEQ ID NO: 540364
  misc_feature: HIJSMM301BNXNN.18.9.A09.1.454.light.4.raw

SEQ ID NO: 572584 - DNA, 493 bp, Homo sapiens
  misc_feature: HIJSMM301DN0JQ.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttatactgtcagcagtataatactggcctccacggtacacttttggccaggggaccaagctggagatcaacgaactgtggctgcaccatctgt

SEQ ID NO: 572585 - DNA, 444 bp, Homo sapiens; identical to SEQ ID NO: 535594
  misc_feature: HIJSMM301EFD2D.9.9.A09.1.454.light.4.raw

SEQ ID NO: 572586 - DNA, 487 bp, Homo sapiens; identical to SEQ ID NO: 536206
  misc_feature: HIJSMM301EL4XR.47.38.D05.1.454.light.4.raw

SEQ ID NO: 572587 - DNA, 514 bp, Homo sapiens
  misc_feature: HIJSMM301CXSTE.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtctaagtcagcccaaggctgccccctcggtcactctgttcccgccctcctcg

SEQ ID NO: 572588 - DNA, 404 bp, Homo sapiens
  misc_feature: HIJSMM301CMYQB.11.67.G01.1.454.light.4.raw
cgagagataccacgaccggtgctcgatttagagtatacatattgggtttggggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactctgttcccgccctcctcgtatctctcg

SEQ ID NO: 572589 - DNA, 496 bp, Homo sapiens
  misc_feature: HIJSMM301BJVQZ.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgtgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcactcc

SEQ ID NO: 572590 - DNA, 479 bp, Homo sapiens
  misc_feature: HIJSMM301EFJWI.12.1.A01.1.454.light.4.raw
atacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacaggatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccta

SEQ ID NO: 572591 - DNA, 466 bp, Homo sapiens
  misc_feature: HIJSMM301DV4C7.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatccagcgaa

SEQ ID NO: 572592 - DNA, 494 bp, Homo sapiens
  misc_feature: HIJSMM301BC3P0.47.78.H01.1.454.light.4.raw
  modified_base (54)..(54): a, c, t, g, unknown or other
agctcacgtacacgaccggtgctcgatttagtgtgagtagtttgggtttgggtnatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggagtgttggggtttgttcctccatgcaaggtacacactggccttttggccaggggaccaacctggagatcaaatggaactgtggctgcaccatctgtctt

SEQ ID NO: 572593 - DNA, 510 bp, Homo sapiens
  misc_feature: HIJSMM301A2MMI.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaggtggagatcaaacgaactgtggctgcaccatctgtcttcattcc

SEQ ID NO: 572594 - DNA, 496 bp, Homo sapiens
  misc_feature: HIJSMM301BD8E2.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggccaacggacaacggtaggaagtacaaacgaaactagtggctgcaccactcttcg

SEQ ID NO: 572595 - DNA, 488 bp, Homo sapiens
  misc_feature: HIJSMM301AHAMM.4.57.F02.1.454.light.4.raw
agcactgtagcacgaccggtgctcgatttagctcgatatagttgggtttggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccgaaggtggagatcaaacgaactgtggctgcaccatctgtt

SEQ ID NO: 572596 - DNA, 497 bp, Homo sapiens; identical to SEQ ID NO: 535740
  misc_feature: HIJSMM301BFB01.3.71.G05.1.454.light.4.raw

SEQ ID NO: 572597 - DNA, 512 bp, Homo sapiens
  misc_feature: HIJSMM301AMPS2.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaacggtaggaaagtacaagacgaactagtggctgcgaccatctgtcttcactcttcccgt

SEQ ID NO: 572598 - DNA, 507 bp, Homo sapiens
  misc_feature: HIJSMM301B487L.5.60.F05.1.454.light.4.raw
atcagacacgcacgaccggtgctcgatttagtacgtcatcagggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtctcggtcagcccaaggctgccccctc

SEQ ID NO: 572599 - DNA, 492 bp, Homo sapiens; identical to SEQ ID NO: 566665
  misc_feature: HIJSMM301DBFEM.26.78.H01.1.454.light.4.raw

SEQ ID NO: 572600 - DNA, 489 bp, Homo sapiens
  misc_feature: HIJSMM301D7Z99.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatcagacgaactgtggctgcaccatct

SEQ ID NO: 572601 - DNA, 510 bp, Homo sapiens; identical to SEQ ID NO: 540474
  misc_feature: HIJSMM301AQN8B.5.27.C05.1.454.light.4.raw

SEQ ID NO: 572602 - DNA, 520 bp, Homo sapiens; identical to SEQ ID NO: 539176
  misc_feature: HIJSMM301ED79T.27.23.C01.1.454.light.4.raw

SEQ ID NO: 572603 - DNA, 487 bp, Homo sapiens; identical to SEQ ID NO: 540315
  misc_feature: HIJSMM301CXEKH.15.49.E05.1.454.light.4.raw

SEQ ID NO: 572604 - DNA, 490 bp, Homo sapiens; identical to SEQ ID NO: 551475
  misc_feature: HIJSMM301EVAK9.51.71.G05.1.454.light.4.raw

SEQ ID NO: 572605 - DNA, 514 bp, Homo sapiens
  misc_feature: HIJSMM301EPR5P.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgacctctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcgctacgtaga

SEQ ID NO: 572606 - DNA, 476 bp, Homo sapiens
  misc_feature: HIJSMM301AL6MF.40.2.A02.1.454.light.4.raw
tctagcgactcacgaccggtgctcgatttagactcatctacaggggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtggagtcccatcaaggttcagcggcagtggatctggcacagatttcactctcaccatcagcagcctgcagcctgaagtattttgcaacttattactgtctacaagattacaattaccctcggacgttcggtccgacgggaccgaacggtaggagtagtcaagacgaacgta

SEQ ID NO: 572607 - DNA, 484 bp, Homo sapiens; identical to SEQ ID NO: 535240
  misc_feature: HIJSMM301CXEH2.47.60.F05.1.454.light.4.raw

SEQ ID NO: 572608 - DNA, 499 bp, Homo sapiens
  misc_feature: HIJSMM301D1LXM.3.33.C11.1.454.light.4.raw
agacgcactccacgaccggtgctcgatttagagtgagctcgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggttaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccccg

SEQ ID NO: 572609 - DNA, 454 bp, Homo sapiens; identical to SEQ ID NO: 534964
  misc_feature: HIJSMM301EWKUX.19.86.H09.1.454.light.4.raw

SEQ ID NO: 572610 - DNA, 416 bp, Homo sapiens; identical to SEQ ID NO: 545902
  misc_feature: HIJSMM301AWCAX.18.78.H01.1.454.light.4.raw

SEQ ID NO: 572611 - DNA, 508 bp, Homo sapiens; identical to SEQ ID NO: 561089
  misc_feature: HIJSMM301AYP95.3.37.D04.1.454.light.4.raw

SEQ ID NO: 572612 - DNA, 454 bp, Homo sapiens; identical to SEQ ID NO: 534964
  misc_feature: HIJSMM301CV6LV.19.86.H09.1.454.light.4.raw

SEQ ID NO: 572613 - DNA, 476 bp, Homo sapiens
  misc_feature: HIJSMM301CLLAN.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcaacactgcccgctatgtcttcggaactgggaccaaggtcaccgtcctaagtcagcccaac

SEQ ID NO: 572614 - DNA, 513 bp, Homo sapiens
  misc_feature: HIJSMM301DX6N5.7.34.D01.1.454.light.4.raw
cgtgtctctacacgaccggtgctcgatttagatcgtctgtgttggggtttggggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacagggacagcattatttgggtgttcggcggagggaccaagctgaccgtcctgcgtcagcccaaggctgccccctcggtcactt

SEQ ID NO: 572615 - DNA, 508 bp, Homo sapiens
  misc_feature: HIJSMM301DZQQO.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgatttattactgcagctcatatgcagttggttcctctttcaagatattcggcggagggaccaggctgaccgtcctgacgtcagcccaagggcctcgcccccc

SEQ ID NO: 572616 - DNA, 506 bp, Homo sapiens
  misc_feature: HIJSMM301BTSF7.40.67.G01.1.454.light.4.raw
  modified_base (436)..(436): a, c, t, g, unknown or other
tctagcgactcacgaccggtgctcgatttagagtatacatattgggtttggggaggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctnacgttcggcggagggaccaaggtggacatcaaacgactgtggctgcaccatctgtcttcatcttcccgca

SEQ ID NO: 572617 - DNA, 497 bp, Homo sapiens
  misc_feature: HIJSMM301CV1ZB.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttactgtcagcagtatagtaactggcctccgtactacttttggccaggggaccaagctagaaatcaaacgaactgtggctgcaccatctgtcttcta

SEQ ID NO: 572618 - DNA, 493 bp, Homo sapiens; identical to SEQ ID NO: 537912
  misc_feature: HIJSMM301BW01E.13.46.E02.1.454.light.4.raw

SEQ ID NO: 572619 - DNA, 484 bp, Homo sapiens; identical to SEQ ID NO: 535400
  misc_feature: HIJSMM301DSBL0.46.26.C04.1.454.light.4.raw

SEQ ID NO: 572620 - DNA, 513 bp, Homo sapiens
  misc_feature: HIJSMM301C4XK4.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgtcccaccctcct

SEQ ID NO: 572621 - DNA, 517 bp, Homo sapiens; identical to SEQ ID NO: 557812
  misc_feature: HIJSMM301CU4JT.22.30.C08.1.454.light.4.raw

SEQ ID NO: 572622 - DNA, 503 bp, Homo sapiens
  misc_feature: HIJSMM301DBUPB.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttggaactgggaccaaggtcaccgtctaggtcagcccaaggccaacccactgtca

SEQ ID NO: 572623 - DNA, 493 bp, Homo sapiens
  misc_feature: HIJSMM301C4R8H.41.10.A10.1.454.light.4.raw
tctatactatcacgaccggtgctcgatttagcgtcgatctcaggggatgagcaagactgacaagtcaaggcaggaagatgttgccatcacaactcattgggtttctgctgctctgggttccagcctccaggggtgaaattgtgctgactcagtctccaggctttcagtcctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctcaaacgttcggccaagggaccaaggtggaaatcaaacgaactgtggctgcaccatctgtcttcatcttccccg

SEQ ID NO: 572624 - DNA, 494 bp, Homo sapiens
  misc_feature: HIJSMM301BMFON.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacgatcaagcgaactcgtggctgcaccatctgtt

SEQ ID NO: 572625 - DNA, 511 bp, Homo sapiens; identical to SEQ ID NO: 548439
  misc_feature: HIJSMM301ETH4W.16.46.E02.1.454.light.4.raw

SEQ ID NO: 572626 - DNA, 443 bp, Homo sapiens
  misc_feature: HIJSMM301DPGJD.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcgcgggaccaagttgaccgtcctacgtcagcccaaggctgccccctcggtcactctgttcccgccctcctccactactatg

SEQ ID NO: 572627 - DNA, 445 bp, Homo sapiens
  misc_feature: HIJSMM301DT2FL.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggacaaggtcaccgtcctaagtcagcccaaggccaacccctctgtcactctgttcccacctcctccatactcgta

SEQ ID NO: 572628 - DNA, 485 bp, Homo sapiens
  misc_feature: HIJSMM301D5V5R.47.60.F05.1.454.light.4.raw
  modified_base (472)..(472): a, c, t, g, unknown or other
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgaactggagattaaacgaacngtggctgcaccat

SEQ ID NO: 572629 - DNA, 443 bp, Homo sapiens; identical to SEQ ID NO: 549023
  misc_feature: HIJSMM301CMLF9.8.73.G07.1.454.light.4.raw

SEQ ID NO: 572630 - DNA, 459 bp, Homo sapiens
  misc_feature: HIJSMM301AVOQ4.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccgaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctcgccccctcggtcactctcgttcccaccctccctccacgagagta

SEQ ID NO: 572631 - DNA, 488 bp, Homo sapiens; identical to SEQ ID NO: 537055
  misc_feature: HIJSMM301ESC4H.4.64.F09.1.454.light.4.raw

SEQ ID NO: 572632 - DNA, 476 bp, Homo sapiens; identical to SEQ ID NO: 561229
  misc_feature: HIJSMM301D76MP.52.73.G07.1.454.light.4.raw

SEQ ID NO: 572633 - DNA, 499 bp, Homo sapiens
  misc_feature: HIJSMM301DWKU6.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgaacggtcggagtgtcgtaagacgaacgtgtggcgtggcaccatcttcg

SEQ ID NO: 572634 - DNA, 491 bp, Homo sapiens
  misc_feature: HIJSMM301AUDHL.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggccaagggaccaaggtaggaatacaaacgaaactgtggctgcaccactctgtctt

SEQ ID NO: 572635 - DNA, 521 bp, Homo sapiens; identical to SEQ ID NO: 562813
  misc_feature: HIJSMM301C3LTY.10.86.H09.1.454.light.4.raw

SEQ ID NO: 572636 - DNA, 489 bp, Homo sapiens
  misc_feature: HIJSMM301EGE43.48.10.A10.1.454.light.4.raw
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgacgggtggaaagtacaaacgaactagtggctgcaccatctgtcttctat

SEQ ID NO: 572637 - DNA, 488 bp, Homo sapiens
  misc_feature: HIJSMM301DCTUI.22.65.F10.1.454.light.4.raw
  modified_base (417)..(417): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtncccccccgatcaccttcgccaaggacacgactggagattaacgaactgtggctgcaccatctgtcttcatt

SEQ ID NO: 572638 - DNA, 494 bp, Homo sapiens; identical to SEQ ID NO: 535680
  misc_feature: HIJSMM301DDKO5.16.78.H01.1.454.light.4.raw

SEQ ID NO: 572639 - DNA, 476 bp, Homo sapiens; identical to SEQ ID NO: 537368
  misc_feature: HIJSMM301BWO61.7.83.H06.1.454.light.4.raw

SEQ ID NO: 572640 - DNA, 504 bp, Homo sapiens
  misc_feature: HIJSMM301AQNG2.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcaatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacg

SEQ ID NO: 572641 - DNA, 502 bp, Homo sapiens; identical to SEQ ID NO: 543913
  misc_feature: HIJSMM301CWIJ4.18.26.C04.1.454.light.4.raw

SEQ ID NO: 572642 - DNA, 493 bp, Homo sapiens
  misc_feature: HIJSMM301ECP8S.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcaccaagtcacgtcctgggtcagcccaaggccaaccccactgtcactctcg

SEQ ID NO: 572643 - DNA, 488 bp, Homo sapiens; identical to SEQ ID NO: 536851
  misc_feature: HIJSMM301ETUFN.41.2.A02.1.454.light.4.raw

SEQ ID NO: 572644 - DNA, 509 bp, Homo sapiens
  misc_feature: HIJSMM301BVBCP.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggtcaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccg

SEQ ID NO: 572645 - DNA, 508 bp, Homo sapiens
  misc_feature: HIJSMM301DMAA9.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctcgggtcagcccaaggctgccccctcggtcctac

SEQ ID NO: 572646 - DNA, 501 bp, Homo sapiens
  misc_feature: HIJSMM301B5183.47.64.F09.1.454.light.4.raw
  modified_base (477)..(477): a, c, t, g, unknown or other
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattacttgtcagcagcgtgagttctggcctccgctcacttcgtcggagggacgacgggtggaggatcaaacgaactagtggngtgcaccactctcgtcttctactt

SEQ ID NO: 572647 - DNA, 501 bp, Homo sapiens; identical to SEQ ID NO: 555551
  misc_feature: HIJSMM301BIKG5.21.81.H04.1.454.light.4.raw

SEQ ID NO: 572648 - DNA, 508 bp, Homo sapiens; identical to SEQ ID NO: 550253
  misc_feature: HIJSMM301DNJER.9.55.E11.1.454.light.4.raw

SEQ ID NO: 572649 - DNA, 486 bp, Homo sapiens
  misc_feature: HIJSMM301BV46N.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagagtcaaacgaactgtggctgcacca

SEQ ID NO: 572650 - DNA, 513 bp, Homo sapiens
  misc_feature: HIJSMM301C2442.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaacgggaccaaggtaggaaagtacaaacgaactagtggctgcaccaatctgtcttctactctttccccg

SEQ ID NO: 572651 - DNA, 503 bp, Homo sapiens
  misc_feature: HIJSMM301BUUS5.43.69.G03.1.454.light.4.raw
tgtgagtagtcacgaccggtgctcgatttagtcgctgcgtaaaggagaaaggggggtgtgggtccaggaggcagaactctgggtgtctcaccatggcctggatccctctatttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaaggctgaccgtcctaggtcagcccaaggctgccccctcggtcta

SEQ ID NO: 572652 - DNA, 498 bp, Homo sapiens
  misc_feature: HIJSMM301DU90B.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctggaggacgaggctgattattactgcagctcatatacaagcaccagcactctctatgtcttcggaactgggaccaaggtccaccgtcctaggtcagcccaagg

SEQ ID NO: 572653 - DNA, 502 bp, Homo sapiens; identical to SEQ ID NO: 546688
  misc_feature: HIJSMM301EOWXX.41.26.C04.1.454.light.4.raw

SEQ ID NO: 572654 - DNA, 483 bp, Homo sapiens; identical to SEQ ID NO: 535413
  misc_feature: HIJSMM301BOFJV.26.78.H01.1.454.light.4.raw

SEQ ID NO: 572655 - DNA, 500 bp, Homo sapiens
  misc_feature: HIJSMM301DXAOZ.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaagtcagcccaaggccaacccct

SEQ ID NO: 572656 - DNA, 499 bp, Homo sapiens
  misc_feature: HIJSMM301EY7D0.48.59.F04.1.454.light.4.raw
agtatacatacacgaccggtgctcgatttagtacacacacttagggattggggggggaaccatggaaaccccagcgcagcttctcttcctcctgctactctggctcccagatgcccccggagaaattgtgttgacgcagtctccagacaccctgtctttgtctccaggggaaagagccaccttctcctgcaggttcagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 572657 - DNA, 483 bp, Homo sapiens
  misc_feature: HIJSMM301DSGEH.49.35.D02.1.454.light.4.raw
agtcgagagacacgaccggtgctcgatttagcacacgatagttgggtttgggggagctacaacaggcaggcaggggcagcaagatggtgttgcagacccaggtcttcatgtctctgttgctctggatctctggtgccgtacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttccggaatccgggtccctgagcgattcagtggcagcgggtctgggacagatttcactctcaccatcagcagcctgcagactgaagatgtggcagtgtattactgtcagcaatatcacactgctccgctcactttcggcggaggaccgagggtggagatacaaacg

SEQ ID NO: 572658 - DNA, 496 bp, Homo sapiens
  misc_feature: HIJSMM301DGMTC.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcaccatctgtcttcatt

SEQ ID NO: 572659 - DNA, 503 bp, Homo sapiens; identical to SEQ ID NO: 536834
  misc_feature: HIJSMM301D0301.2.35.D02.1.454.light.4.raw

SEQ ID NO: 572660 - DNA, 507 bp, Homo sapiens
  misc_feature: HIJSMM301EX3KL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgtcggtccaagggaccaaggtggaaagtacaaacgaactagtggctgcaccatctgtcttctatcttccccg

SEQ ID NO: 572661 - DNA, 486 bp, Homo sapiens
  misc_feature: HIJSMM301CAZS1.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 572662 - DNA, 501 bp, Homo sapiens; identical to SEQ ID NO: 535873
  misc_feature: HIJSMM301CSSE5.17.27.C05.1.454.light.4.raw

SEQ ID NO: 572663 - DNA, 499 bp, Homo sapiens
  misc_feature: HIJSMM301CE341.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccactcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagactttcactctcaccatcagcagcctgcaggctgaagatgtggcagtttattattgtcagcaatattatattcctcctcagacgttcggccaagggaccaaggtggaaatcaaacgaactgtggctgcacca

SEQ ID NO: 572664 - DNA, 489 bp, Homo sapiens
  misc_feature: HIJSMM301DELK6.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgactgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgt

SEQ ID NO: 572665 - DNA, 507 bp, Homo sapiens
  misc_feature: HIJSMM301A2FD3.3.37.D04.1.454.light.4.raw
agacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggccaacccactgtcact

SEQ ID NO: 572666 - DNA, 499 bp, Homo sapiens; identical to SEQ ID NO: 537739
  misc_feature: HIJSMM301DONCT.12.86.H09.1.454.light.4.raw

SEQ ID NO: 572667 - DNA, 486 bp, Homo sapiens; identical to SEQ ID NO: 535385
  misc_feature: HIJSMM301CT5OH.19.71.G05.1.454.light.4.raw

SEQ ID NO: 572668 - DNA, 485 bp, Homo sapiens; identical to SEQ ID NO: 536040
  misc_feature: HIJSMM301C1251.15.1.A01.1.454.light.4.raw

SEQ ID NO: 572669 - DNA, 486 bp, Homo sapiens; identical to SEQ ID NO: 535043
  misc_feature: HIJSMM301DPHN2.46.35.D02.1.454.light.4.raw

SEQ ID NO: 572670 - DNA, 500 bp, Homo sapiens
  misc_feature: HIJSMM301EVT8W.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagctttatgttaattcacctccgtcgtacatctttggccaggggaccaagctggagatcaaacgaactgtggctgcaccatctgtcttcattccc

SEQ ID NO: 572671 - DNA, 496 bp, Homo sapiens
  misc_feature: HIJSMM301B0RGY.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactttctacaagattacaattaccctcggacgttcggtccagggaccgaacggtaggaaagtacaaacgaactacgtggctgcaccact

SEQ ID NO: 572672 - DNA, 494 bp, Homo sapiens; identical to SEQ ID NO: 534992
  misc_feature: HIJSMM301AQGOJ.9.1.A01.1.454.light.4.raw

SEQ ID NO: 572673 - DNA, 494 bp, Homo sapiens; identical to SEQ ID NO: 549057
  misc_feature: HIJSMM301C44R7.10.33.C11.1.454.light.4.raw

SEQ ID NO: 572674 - DNA, 497 bp, Homo sapiens; identical to SEQ ID NO: 535764
  misc_feature: HIJSMM301DQPF2.22.20.B09.1.454.light.4.raw

SEQ ID NO: 572675 - DNA, 489 bp, Homo sapiens; identical to SEQ ID NO: 568717
  misc_feature: HIJSMM301DV2WD.11.12.B01.1.454.light.4.raw

SEQ ID NO: 572676 - DNA, 528 bp, Homo sapiens
  misc_feature: HIJSMM301DG5Z1.46.67.G01.1.454.light.4.raw
actagcagtacacgaccggtgctcgatttagagtatacatattgggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccagggaaggggctggaatacattggaagtgtctctcatagtggaggttcctattacagtccgtctctcaagagtcgagtcaccatatctctggacacgtccagcaatcagttttccctgaagatgagttctgtgaccgccgctgacacgggcgtttattactgtgcgagagacggctattatgatttttggagtggttatttcgacaccctagatcgacgggggctcgacccctggggccagggaatactggtcaccgtctccttagcctccaccaagggcccatcggtcttccccctggcaccctcctccaagag

SEQ ID NO: 572677 - DNA, 504 bp, Homo sapiens
  misc_feature: HIJSMM301AREMX.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgtttcggcggagggaccaaactgaccgtcctaggtcagccccaa

SEQ ID NO: 572678 - DNA, 507 bp, Homo sapiens; identical to SEQ ID NO: 563344
  misc_feature: HIJSMM301BUUNP.3.79.H02.1.454.light.4.raw

SEQ ID NO: 572679 - DNA, 491 bp, Homo sapiens; identical to SEQ ID NO: 535166
  misc_feature: HIJSMM301AT8E8.47.78.H01.1.454.light.4.raw

SEQ ID NO: 572680 - DNA, 496 bp, Homo sapiens
  misc_feature: HIJSMM301CL19X.48.31.C09.1.454.light.4.raw
agtatacatacacgaccggtgctcgatttagacgtctcatcaaggaaggaagggggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcat

SEQ ID NO: 572681 - DNA, 495 bp, Homo sapiens
  misc_feature: HIJSMM301C7FC5.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcagggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcgagtgcgtct

SEQ ID NO: 572682 - DNA, 500 bp, Homo sapiens
  misc_feature: HIJSMM301DVFIP.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaagtcaaacgaactagtggctgcacc

SEQ ID NO: 572683 - DNA, 513 bp, Homo sapiens
  misc_feature: HIJSMM301EPH30.17.2.A02.1.454.light.4.raw
  modified_base (492)..(492): a, c, t, g, unknown or other
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaacccccnctgtcactctgttcccaccct

SEQ ID NO: 572684 - DNA, 469 bp, Homo sapiens; identical to SEQ ID NO: 536091
  misc_feature: HIJSMM301DRSR7.3.82.H05.1.454.light.4.raw

SEQ ID NO: 572685 - DNA, 499 bp, Homo sapiens
  misc_feature: HIJSMM301AHTFL.15.25.C03.1.454.light.4.raw
tctacgtagccacgaccggtgctcgatttagtagtgtagatttgggtttgggggatcaggactcctcatttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactagtggctgcaccat

SEQ ID NO: 572686 - DNA, 505 bp, Homo sapiens; identical to SEQ ID NO: 535503
  misc_feature: HIJSMM301EXAZR.8.28.C06.1.454.light.4.raw

SEQ ID NO: 572687 - DNA, 483 bp, Homo sapiens; identical to SEQ ID NO: 536691
  misc_feature: HIJSMM301A2982.17.26.C04.1.454.light.4.raw

SEQ ID NO: 572688 - DNA, 422 bp, Homo sapiens; identical to SEQ ID NO: 447881
  misc_feature: HIJSMM301C0XUA.9.34.D01.1.454.light.4.raw

SEQ ID NO: 572689 - DNA, 420 bp, Homo sapiens; identical to SEQ ID NO: 540533
  misc_feature: HIJSMM301C4MGO.9.34.D01.1.454.light.4.raw

SEQ ID NO: 572690 - DNA, 494 bp, Homo sapiens; identical to SEQ ID NO: 553476
  misc_feature: HIJSMM301DGJMG.16.53.E09.1.454.light.4.raw

SEQ ID NO: 572691 - DNA, 500 bp, Homo sapiens
  misc_feature: HIJSMM301BNNMU.15.37.D04.1.454.light.4.raw
tctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtccctcatcaagaaggcgtctactttagaagctggggtcccgtcaagattcagcgccggtggatctgggacagaattcactctcaccatcaacagcctggaacctgatgatttgcaacttattactgccaacactatgatactcacccgtacacttttggccaggggaccaagctggagatcaaaggaactgtggctgcaccatctgtcttcatcttcccg

SEQ ID NO: 572692 - DNA, 504 bp, Homo sapiens
  misc_feature: HIJSMM301DLU2V.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctggtccta

SEQ ID NO: 572693 - DNA, 488 bp, Homo sapiens
  misc_feature: HIJSMM301E0SL6.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttggcggagggaccaagtggagatcaaagaaa

SEQ ID NO: 572694 - DNA, 486 bp, Homo sapiens
  misc_feature: HIJSMM301B7MQB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatatttgtcaacaatattattatacttcgtggacgttcggccaagggaccaaggtggatatcagacgaa

SEQ ID NO: 572695 - DNA, 486 bp, Homo sapiens
  misc_feature: HIJSMM301BMYGA.47.38.D05.1.454.light.4.raw
  modified_base (476)..(476): a, c, t, g, unknown or other
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttgggtttattactgcatgcaagttctacaaacttcctacacttttggccaggggaccaagctgganatcaaacgaa

SEQ ID NO: 572696 - DNA, 506 bp, Homo sapiens
  misc_feature: HIJSMM301B4RS2.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctggtcactctgttcccaccct

SEQ ID NO: 572697 - DNA, 463 bp, Homo sapiens
  misc_feature: HIJSMM301DJSJM.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaacatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 572698 - DNA, 490 bp, Homo sapiens
  misc_feature: HIJSMM301ARG92.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggtccctcgggaccgaaactgtggataatcaaacgaaactagtggctgcaccatctgtctt

SEQ ID NO: 572699 - DNA, 519 bp, Homo sapiens
  misc_feature: HIJSMM301B6MCV.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaagtgaccgtcctaagtcagcccaaggctgccccctcggtcattctgttcccgccct

SEQ ID NO: 572700 - DNA, 416 bp, Homo sapiens
  misc_feature: HIJSMM301AVVC0.41.53.E09.1.454.light.4.raw
tctatactatcacgaccggtgctcgatttagagagagtgtgttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggtcactctgttcccgccctcctcatagtataga

SEQ ID NO: 572701 - DNA, 491 bp, Homo sapiens
  misc_feature: HIJSMM301EX0VP.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtaggaggatcaaacgaaa

SEQ ID NO: 572702 - DNA, 528 bp, Homo sapiens
  misc_feature: HIJSMM301CNVJ6.9.38.D05.1.454.light.4.raw
tgatacgtctcacgaccggtgctcgatttagtatctgatagttgggtttggggggggtcgtcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagccccaaacctcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcggggggaccgaaggtggaccgtcctaagtcagcccaaggctgccccctcggtcactctgttcccaccctcctcacg

SEQ ID NO: 572703 - DNA, 482 bp, Homo sapiens
  misc_feature: HIJSMM301B61U8.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctggaccaatgtggatatcaaacgaactagtggctgcaccatctgtt

SEQ ID NO: 572704 - DNA, 463 bp, Homo sapiens
  misc_feature: HIJSMM301DHHZU.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatcgtatgacagtagtgagcggccctcaggggtccctgaccgattctctggctctaagtctggcacctcggcctccctggacatcagtcggcctccggtccgaggatgaggctgattattactgtgcaggcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 572705 - DNA, 503 bp, Homo sapiens
  misc_feature: HIJSMM301EHOAJ.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttctaagttccttttgtcttcggaactgggaccgaggtcaccgtcctaggtcagcccaaggccaacccactgtcta

SEQ ID NO: 572706 - DNA, 378 bp, Homo sapiens
  misc_feature: HIJSMM301E0UOT.9.11.A11.1.454.light.4.raw
tgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagattttgcagtttattactgtcagcagtatggtagctcaccgtacacttttggccaggggaccgaagctggagatcaaacgaaactgtggctgcaccatctgtcttcatcttcccgtccatctgaagacgtatca

SEQ ID NO: 572707 - DNA, 490 bp, Homo sapiens; identical to SEQ ID NO: 535420
  misc_feature: HIJSMM301DPR85.3.72.G06.1.454.light.4.raw

SEQ ID NO: 572708 - DNA, 472 bp, Homo sapiens; identical to SEQ ID NO: 562597
  misc_feature: HIJSMM301BOTIQ.3.38.D05.1.454.light.4.raw

SEQ ID NO: 572709 - DNA, 498 bp, Homo sapiens
  misc_feature: HIJSMM301DQSCB.11.59.F04.1.454.light.4.raw
  modified_base (492)..(492): a, c, t, g, unknown or other
cgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaaccatctctgggctccaggctgaggatgaggctgattattattgctgctcatatggaagtacctactcttttctcttcggaacttgggaccacggtcacgtcctaggtcagcccaaggccaaccccactgtcactctgttcccaccctctcgtanctctcg

SEQ ID NO: 572710 - DNA, 499 bp, Homo sapiens; identical to SEQ ID NO: 543887
  misc_feature: HIJSMM301DH5AN.10.65.F10.1.454.light.4.raw

SEQ ID NO: 572711 - DNA, 494 bp, Homo sapiens; identical to SEQ ID NO: 536444
  misc_feature: HIJSMM301E1RN2.26.72.G06.1.454.light.4.raw

SEQ ID NO: 572712 - DNA, 491 bp, Homo sapiens; identical to SEQ ID NO: 542310
  misc_feature: HIJSMM301CV1ES.22.65.F10.1.454.light.4.raw

SEQ ID NO: 572713 - DNA, 508 bp, Homo sapiens
  misc_feature: HIJSMM301DPNAT.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggaggaccaagctgaccgtcttaagtcagcccaaggctgccccctggtcactctgttccca

SEQ ID NO: 572714 - DNA, 490 bp, Homo sapiens; identical to SEQ ID NO: 544556
  misc_feature: HIJSMM301DCRBL.15.3.A03.1.454.light.4.raw

SEQ ID NO: 572715 - DNA, 447 bp, Homo sapiens; identical to SEQ ID NO: 535020
  misc_feature: HIJSMM301CE9LV.18.9.A09.1.454.light.4.raw

SEQ ID NO: 572716 - DNA, 508 bp, Homo sapiens
  misc_feature: HIJSMM301C31LU.17.33.C11.1.454.light.4.raw
cgtagactagcacgaccggtgctcgatttagagtgagctcgttgggtttgggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccc

SEQ ID NO: 572717 - DNA, 497 bp, Homo sapiens; identical to SEQ ID NO: 535664
  misc_feature: HIJSMM301EXLXV.22.14.B03.1.454.light.4.raw

SEQ ID NO: 572718 - DNA, 486 bp, Homo sapiens; identical to SEQ ID NO: 538754
  misc_feature: HIJSMM301DROPD.19.5.A05.1.454.light.4.raw

SEQ ID NO: 572719 - DNA, 447 bp, Homo sapiens; identical to SEQ ID NO: 535020
  misc_feature: HIJSMM301DBZMZ.18.9.A09.1.454.light.4.raw

SEQ ID NO: 572720 - DNA, 496 bp, Homo sapiens
  misc_feature: HIJSMM301A1NWY.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccaggggaccaagctggagatcaaacgaactgtggctgcaccatctgtcttcta

SEQ ID NO: 572721 - DNA, 490 bp, Homo sapiens; identical to SEQ ID NO: 551475
  misc_feature: HIJSMM301D7FLX.51.71.G05.1.454.light.4.raw

SEQ ID NO: 572722 - DNA, 492 bp, Homo sapiens
  misc_feature: HIJSMM301CMX0W.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtgctgcacatctgtctt

SEQ ID NO: 572723 - DNA, 480 bp, Homo sapiens
  misc_feature: HIJSMM301DJUYI.47.62.F07.1.454.light.4.raw
  modified_base (451)..(451): a, c, t, g, unknown or other
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacagggtcccatcaaggttcagtggaagtggatctgggacagattttactttctaccatcagcagcctgcagcctgaagatattgcaacatattactgtcaacagtatcataatctcccacttcgcctcggacaacgtgganatcaaacgaactgtggctgcaccatctgt

SEQ ID NO: 572724 - DNA, 497 bp, Homo sapiens; identical to SEQ ID NO: 536371
  misc_feature: HIJSMM301B74BQ.16.78.H01.1.454.light.4.raw

SEQ ID NO: 572725 - DNA, 497 bp, Homo sapiens
  misc_feature: HIJSMM301BE9CB.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcgaccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 572726 - DNA, 490 bp, Homo sapiens
  misc_feature: HIJSMM301CFPEO.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggagggaccaaggccggagatcagacgaactgtggctgcaccatctgtcttcta

SEQ ID NO: 572727 - DNA, 487 bp, Homo sapiens
  misc_feature: HIJSMM301B7O8D.48.53.E09.1.454.light.4.raw
agtatacatacacgaccggtgctcgatttagagagagtgtgttgggtttgggggctgctcagttaggacccagagggaaccatggaaaccccagcgcagcttctcttcctcctgctactctggctcccaaataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcaccat

SEQ ID NO: 572728 - DNA, 494 bp, Homo sapiens; identical to SEQ ID NO: 535629
  misc_feature: HIJSMM301DE4ZG.4.27.C05.1.454.light.4.raw

SEQ ID NO: 572729 - DNA, 497 bp, Homo sapiens; identical to SEQ ID NO: 536807
  misc_feature: HIJSMM301CDMOU.10.37.D04.1.454.light.4.raw

SEQ ID NO: 572730 - DNA, 499 bp, Homo sapiens
  misc_feature: HIJSMM301BZN1B.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctcgccccctcggtcactctccg

SEQ ID NO: 572731 - DNA, 494 bp, Homo sapiens; identical to SEQ ID NO: 534992
  misc_feature: HIJSMM301AKQSN.9.1.A01.1.454.light.4.raw

SEQ ID NO: 572732 - DNA, 501 bp, Homo sapiens
  misc_feature: HIJSMM301ALAAY.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagttttattactgtcagcagcgtatcgactggatcaccttcggccaagggacacgactggaaattaaacgaactgtggctgcaccatctgtcttcatcttccccg

SEQ ID NO: 572733 - DNA, 484 bp, Homo sapiens; identical to SEQ ID NO: 540581
  misc_feature: HIJSMM301DRX17.3.88.H11.1.454.light.4.raw

SEQ ID NO: 572734 - DNA, 477 bp, Homo sapiens
  misc_feature: HIJSMM301CBLR2.11.11.A11.1.454.light.4.raw
  modified_base (459)..(459): a, c, t, g, unknown or other
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgcctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggaggaccgcggtggagatcagacgaactgnggctgcaccatctgtctt

SEQ ID NO: 572735 - DNA, 485 bp, Homo sapiens
  misc_feature: HIJSMM301ESG9R.40.15.B04.1.454.light.4.raw
tctagcgactcacgaccggtgctcgatttagacagtatatatccgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacgtcggccaagggaccaaggtggaaatcaagcgaactgtgg

SEQ ID NO: 572736 - DNA, 463 bp, Homo sapiens
  misc_feature: HIJSMM301AZ4S4.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcatctctatgtcttcggaactgggaccaaggtcaccgtcctaggtcagcccaaggccaaccccactgtcactctgttcccgccctcctccatactcgta

SEQ ID NO: 572737 - DNA, 488 bp, Homo sapiens
  misc_feature: HIJSMM301EULWH.5.40.D07.1.454.light.4.raw
atcagacacgcacgaccggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtggctgcaccatctgtt

SEQ ID NO: 572738 - DNA, 491 bp, Homo sapiens
  misc_feature: HIJSMM301COXLR.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagtggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatt

SEQ ID NO: 572739 - DNA, 497 bp, Homo sapiens
  misc_feature: HIJSMM301DQGTB.43.73.G07.1.454.light.4.raw
tgtgagtagtcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccgaagggggatgggcagtccctgatcggttctcagtcttgggctcaggcctgactcggtccctgaccatcaacaacatccaggaagaggatgacagtgactactactgtgggacgtaattatggcagtgggaatacctacatgtatgtctttggaagtggacgaaggtcacgtccaaggtcacg

SEQ ID NO: 572740 - DNA, 443 bp, Homo sapiens
  misc_feature: HIJSMM301ETPJC.11.3.A03.1.454.light.4.raw
cgagagataccacgaccggtgctcgatttagagagcgtcacagggtcctgggcccagtctgtgctgacgcagccgccctcagtgtctcggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtgggtattcggcggagggacccacgtaaccgtcctaggtcagcccaaggctgccccctcggtcactctgttcccaccctcctcgtatctctcg

SEQ ID NO: 572741 - DNA, 521 bp, Homo sapiens; identical to SEQ ID NO: 538715
  misc_feature: HIJSMM301CO3QI.27.23.C01.1.454.light.4.raw

SEQ ID NO: 572742 - DNA, 496 bp, Homo sapiens
  misc_feature: HIJSMM301AIORR.41.35.D02.1.454.light.4.raw
tctatactatcacgaccggtgctcgatttagcacacgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtctaggtcagcccaagg

SEQ ID NO: 572743 - DNA, 497 bp, Homo sapiens; identical to SEQ ID NO: 535664
  misc_feature: HIJSMM301ATQEY.22.14.B03.1.454.light.4.raw

SEQ ID NO: 572744 - DNA, 495 bp, Homo sapiens; identical to SEQ ID NO: 535486
  misc_feature: HIJSMM301A6PD2.26.72.G06.1.454.light.4.raw

SEQ ID NO: 572745 - DNA, 487 bp, Homo sapiens; identical to SEQ ID NO: 551272
  misc_feature: HIJSMM301AXOSZ.4.59.F04.1.454.light.4.raw

SEQ ID NO: 572746 - DNA, 505 bp, Homo sapiens
  misc_feature: HIJSMM301EBIP6.51.50.E06.1.454.light.4.raw
cgatcgtatacacgaccggtgctcgatttagatctactgacaacacacaagggggctgtgggctcagaagcagagttctggggtgtctccaccatggcctggacccctctctggctcactctcctcactctttgcataggttctgtggtttcctctgagctgactcaggaccccgctgtatctgtggccttgggacagacagtcaggatcacatgccaaggagacagcctcacaagttattatgcaggctggtaccagcagaagccaggacaagcccctatacttgtcctctatggtaataatcaccggccctcagggatcccagaccgattctctggctccagctcaggaaacacagcttccttgaccatcactggggctcaggcggaagatgaggctgactactactgtaattcccgggacaccagtggtcatagtggaaaccgggtcgtgttcggcggaggaccaaggtgaccgtcctgggtcagcccaaggctgccccctc

SEQ ID NO: 572747 - DNA, 380 bp, Homo sapiens
  misc_feature: HIJSMM301CYY2H.49.24.C02.1.454.light.4.raw
agtcgagagacacgaccggtgctcgatttagtacagatcgttagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaacccactgtcactctgttcccacctcctctctctcgact

SEQ ID NO: 572748 - DNA, 495 bp, Homo sapiens
  misc_feature: HIJSMM301AOR2W.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcagggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggct

SEQ ID NO: 572749 - DNA, 486 bp, Homo sapiens; identical to SEQ ID NO: 539057
  misc_feature: HIJSMM301CM3PQ.47.70.G04.1.454.light.4.raw

SEQ ID NO: 572750 - DNA, 493 bp, Homo sapiens
  misc_feature: HIJSMM301C1NJO.51.45.E01.1.454.light.4.raw
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggagtgttggggtttagttactgcgtgcaaagtactgcaaactatcaccttcggtccaacgggacgacgactggagattaaacgaactagtgg

SEQ ID NO: 572751 - DNA, 492 bp, Homo sapiens
  misc_feature: HIJSMM301DFUA9.18.22.B11.1.454.light.4.raw
tacgagtatgcacgaccggtgctcgatttagacgacagctcaggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtattttaaagaactccaacaatcagaattacttaacttggtatcagcagaaagcaggccagcctcccaagttgctcatttactgggcatcaacccgggaatccggggtccctgaccgattcagtggcagcgggtctgggacagacttcactctcaccatcagcagcctgcaggctgaagatgtggcagtttattactgtcagcagtattatagtactcctccgacgttcggccaagggaccaaggtggagattaaacgaactgtggctgcaccatctgtcttcatcttcccgccat

SEQ ID NO: 572752 - DNA, 495 bp, Homo sapiens
  misc_feature: HIJSMM301C37ZX.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggtcaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgcc

SEQ ID NO: 572753 - DNA, 508 bp, Homo sapiens
  misc_feature: HIJSMM301DC4D0.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacggaggctgattattactgctgctcatattcaagtcgtgtcactatgattttggtcggaggcaccaaggtgaccgtcctaggtcagcccaaggctgccccctcggtcta

SEQ ID NO: 572754 - DNA, 484 bp, Homo sapiens
  misc_feature: HIJSMM301BVWQ0.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctacgtga

SEQ ID NO: 572755 - DNA, 492 bp, Homo sapiens
  misc_feature: HIJSMM301EGBW5.40.81.H04.1.454.light.4.raw
tctagcgactcacgaccggtgctcgatttagtagtgtagattcgcggggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcaa

SEQ ID NO: 572756 - DNA, 516 bp, Homo sapiens; identical to SEQ ID NO: 552129
  misc_feature: HIJSMM301EA5YW.27.23.C01.1.454.light.4.raw

SEQ ID NO: 572757 - DNA, 494 bp, Homo sapiens; identical to SEQ ID NO: 559643
  misc_feature: HIJSMM301DI7XU.27.78.H01.1.454.light.4.raw

SEQ ID NO: 572758 - DNA, 510 bp, Homo sapiens
  misc_feature: HIJSMM301EE9DX.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattatttactgtgcaccgtgggatgacatcctgaatggtccggtgttcggcggagggaccaggctgaccgtcctaagtcagcccaaggctgccccctc

SEQ ID NO: 572759 - DNA, 486 bp, Homo sapiens; identical to SEQ ID NO: 535458
  misc_feature: HIJSMM301BMBV6.7.75.G09.1.454.light.4.raw

SEQ ID NO: 572760 - DNA, 489 bp, Homo sapiens; identical to SEQ ID NO: 543840
  misc_feature: HIJSMM301C53Q6.12.88.H11.1.454.light.4.raw

SEQ ID NO: 572761 - DNA, 504 bp, Homo sapiens
  misc_feature: HIJSMM301DMO6J.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagccagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccagggaccaaggtggaaatcaaacgaactgtggctgcaccat

SEQ ID NO: 572762 - DNA, 498 bp, Homo sapiens
  misc_feature: HIJSMM301EHT5X.11.59.F04.1.454.light.4.raw
  modified_base (462)..(462): a, c, t, g, unknown or other
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaccncctgtcactctgttcccaccctcctcgtatctctcg

SEQ ID NO: 572763 - DNA, 465 bp, Homo sapiens
  misc_feature: HIJSMM301AJ2OV.18.76.G10.1.454.light.4.raw
tacgagtatgcacgaccggtgctcgatttagtcactcatacagggggcgaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctgcagcctgaagattttgcaacttactattgtcaacaggctgacaggttccgctgacttcgtcggaggaccgaaggtagagatcaaaggaa

SEQ ID NO: 572764 - DNA, 505 bp, Homo sapiens; identical to SEQ ID NO: 551816
  misc_feature: HIJSMM301EIW5J.18.78.H01.1.454.light.4.raw

SEQ ID NO: 572765 - DNA, 500 bp, Homo sapiens
  misc_feature: HIJSMM301A08DY.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtcaaacaccttcggaccgaacgggacacgactggagattaaaggaactgtggctgcaccatctgtcttctatccttccccg

SEQ ID NO: 572766 - DNA, 474 bp, Homo sapiens; identical to SEQ ID NO: 561309
  misc_feature: HIJSMM301DYSDD.5.12.B01.1.454.light.4.raw

SEQ ID NO: 572767 - DNA, 488 bp, Homo sapiens
  misc_feature: HIJSMM301AIAYQ.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagactgtggctgcaccat

SEQ ID NO: 572768 - DNA, 503 bp, Homo sapiens
  misc_feature: HIJSMM301B2123.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattactactgtctgtcctatgacgacgacctacagactccggttttcggcggagggactaagctcgaccgtcctaagtcagcccaaggctcgccccctcc

SEQ ID NO: 572769 - DNA, 497 bp, Homo sapiens
  misc_feature: HIJSMM301AFW28.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcacgccaaggctgccccctcggtcactctcg

SEQ ID NO: 572770 - DNA, 490 bp, Homo sapiens
  misc_feature: HIJSMM301BWP6E.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcgtcagggaccaagttagaacatcaatcaactgtggctgcaccatctgtctt

SEQ ID NO: 572771 - DNA, 490 bp, Homo sapiens; identical to SEQ ID NO: 542396
  misc_feature: HIJSMM301A5S98.16.53.E09.1.454.light.4.raw

SEQ ID NO: 572772 - DNA, 514 bp, Homo sapiens
  misc_feature: HIJSMM301C9LWL.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgacaacctgaagtatttgactaacttactactgtacaacagacgttacaaccgttacccccctctaccgtttcggcgggaacgggaccgaagggcggaagatacacgaacgaactggtggctgccaccatcttgttcttcta

SEQ ID NO: 572773 - DNA, 507 bp, Homo sapiens
  misc_feature: HIJSMM301DOU33.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggcccaaccccactgtcactctcgttcccc

SEQ ID NO: 572774 - DNA, 496 bp, Homo sapiens; identical to SEQ ID NO: 535109
  misc_feature: HIJSMM301BNYO2.16.78.H01.1.454.light.4.raw

SEQ ID NO: 572775 - DNA, 501 bp, Homo sapiens; identical to SEQ ID NO: 535746
  misc_feature: HIJSMM301A658D.18.11.A11.1.454.light.4.raw

SEQ ID NO: 572776 - DNA, 488 bp, Homo sapiens; identical to SEQ ID NO: 538017
  misc_feature: HIJSMM301BDBJT.4.59.F04.1.454.light.4.raw

SEQ ID NO: 572777 - DNA, 485 bp, Homo sapiens; identical to SEQ ID NO: 535653
  misc_feature: HIJSMM301CHYDB.47.62.F07.1.454.light.4.raw

SEQ ID NO: 572778 - DNA, 472 bp, Homo sapiens; identical to SEQ ID NO: 542478
  misc_feature: HIJSMM301DGENC.4.75.G09.1.454.light.4.raw

SEQ ID NO: 572779 - DNA, 499 bp, Homo sapiens
  misc_feature: HIJSMM301ECEEP.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggttttaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccgaacgggaccgaacggtaggaaagtacaaacgaactacgtggctgcacctaa

SEQ ID NO: 572780 - DNA, 489 bp, Homo sapiens; identical to SEQ ID NO: 536663
  misc_feature: HIJSMM301CSBK6.16.72.G06.1.454.light.4.raw

SEQ ID NO: 572781 - DNA, 521 bp, Homo sapiens
  misc_feature: HIJSMM301A7ZII.27.23.C01.1.454.light.4.raw
  modified_base (500)..(500): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggtggttcggcggagggaccaggctgaccgtcctaggtcagcccaaggctgcccccncggtcactctgttcccaccct

SEQ ID NO: 572782 - DNA, 496 bp, Homo sapiens; identical to SEQ ID NO: 536415
  misc_feature: HIJSMM301D9F59.26.26.C04.1.454.light.4.raw

SEQ ID NO: 572783 - DNA, 473 bp, Homo sapiens
  misc_feature: HIJSMM301EDL0C.3.1.A01.1.454.light.4.raw
agacgcactccacgaccggtgctcgatttagacgtctcatcagggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaagaactgtggctgcaccat

SEQ ID NO: 572784 - DNA, 497 bp, Homo sapiens
  misc_feature: HIJSMM301AWM2Y.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtcttcatcttcccgcatcgacata

SEQ ID NO: 572785 - DNA, 487 bp, Homo sapiens; identical to SEQ ID NO: 541755
  misc_feature: HIJSMM301C8NBP.4.64.F09.1.454.light.4.raw

SEQ ID NO: 572786 - DNA, 500 bp, Homo sapiens
  misc_feature: HIJSMM301C9XV4.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctcctgaccgtctctgggctccagactgaggatgaggctgactattactgcagctcatttgcaggcagccgtatactcttcggcggagggaccaagctgaccgtcctaggtcagcccaaggctgccccctc

SEQ ID NO: 572787 - DNA, 504 bp, Homo sapiens; identical to SEQ ID NO: 538940
  misc_feature: HIJSMM301CAII4.2.35.D02.1.454.light.4.raw

SEQ ID NO: 572788 - DNA, 476 bp, Homo sapiens; identical to SEQ ID NO: 537368
  misc_feature: HIJSMM301AJ6YW.7.83.H06.1.454.light.4.raw

SEQ ID NO: 572789 - DNA, 520 bp, Homo sapiens; identical to SEQ ID NO: 539176
  misc_feature: HIJSMM301CUKT2.27.23.C01.1.454.light.4.raw

SEQ ID NO: 572790 - DNA, 515 bp, Homo sapiens
  misc_feature: HIJSMM301ER35X.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccgacgggaccgacacgtagaaatagagacgaacgtagtggctcgtcaccaactctcgtcttctactcttcccgt

SEQ ID NO: 572791 - DNA, 495 bp, Homo sapiens
  misc_feature: HIJSMM301ETQJE.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggaggatcaacgaactagtggctgcaccatctgtt

SEQ ID NO: 572792 - DNA, 507 bp, Homo sapiens
  misc_feature: HIJSMM301AGXJR.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaacgtggatatcaaacgaactagtggctgcaccatctgtctt

SEQ ID NO: 572793 - DNA, 497 bp, Homo sapiens
  misc_feature: HIJSMM301EJACT.40.17.B06.1.454.light.4.raw
tctagcgactcacgaccggtgctcgatttagtcgatagtgaagggggtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaactagtggctgcaccatctgtcttcatcttcccgccat

SEQ ID NO: 572794 - DNA, 500 bp, Homo sapiens
  misc_feature: HIJSMM301EL1FX.40.82.H05.1.454.light.4.raw
tctagcgactcacgaccggtgctcgatttagtcgagctctctcgcgggcacgaccggtgctcgatttagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacggggcccagccagaggatgagtcttattattactgcatgctccatggtggggggtgccgacttgggtggttcggcggac

SEQ ID NO: 572795 - DNA, 490 bp, Homo sapiens
  misc_feature: HIJSMM301ETRCL.10.72.G06.1.454.light.4.raw
catagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgctagctcatatacacccaggggcactctcgtgatattcggcggagggacctggctgaccgtcctacgtcagcccaa

SEQ ID NO: 572796 - DNA, 490 bp, Homo sapiens; identical to SEQ ID NO: 547085
  misc_feature: HIJSMM301EM4UC.12.51.E07.1.454.light.4.raw

SEQ ID NO: 572797 - DNA, 505 bp, Homo sapiens; identical to SEQ ID NO: 563271
  misc_feature: HIJSMM301AHUT4.2.21.B10.1.454.light.4.raw

SEQ ID NO: 572798 - DNA, 494 bp, Homo sapiens; identical to SEQ ID NO: 534992
  misc_feature: HIJSMM301CA5TN.9.1.A01.1.454.light.4.raw

SEQ ID NO: 572799 - DNA, 519 bp, Homo sapiens
  misc_feature: HIJSMM301BC9VF.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccgaggaccgaacggtaggaagtacgaacgaaacgtacgtaggcgtgcaccactctgtcttctactcttcccgtcccact

SEQ ID NO: 572800 - DNA, 490 bp, Homo sapiens; identical to SEQ ID NO: 546232
  misc_feature: HIJSMM301A0AV9.51.28.C06.1.454.light.4.raw

SEQ ID NO: 572801 - DNA, 501 bp, Homo sapiens
  misc_feature: HIJSMM301BB4AW.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggtccaacgggaccgaaggtaggaaagtacaaacgaaaccgtagtggctgcaccaactctgtcttt

SEQ ID NO: 572802 - DNA, 494 bp, Homo sapiens
  misc_feature: HIJSMM301AQEGT.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggcggagggaccaaggtggagatcaaacgaactggtggctgcaccatctgtcttcta

SEQ ID NO: 572803 - DNA, 485 bp, Homo sapiens; identical to SEQ ID NO: 542735
  misc_feature: HIJSMM301AH7J1.26.45.E01.1.454.light.4.raw

SEQ ID NO: 572804 - DNA, 497 bp, Homo sapiens
  misc_feature: HIJSMM301AEX3D.11.59.F04.1.454.light.4.raw
  modified_base (419)..(419): a, c, t, g, unknown or other
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctnatatggatacctacttcttttctcttcggactgggaccacggtccaccgtcctaggtcacgcccgaaggcccaacccc

SEQ ID NO: 572805 - DNA, 497 bp, Homo sapiens; identical to SEQ ID NO: 545672
  misc_feature: HIJSMM301DG79Z.2.49.E05.1.454.light.4.raw

SEQ ID NO: 572806 - DNA, 505 bp, Homo sapiens
  misc_feature: HIJSMM301ALVPT.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccgaaagtggatatcaaacgaactagtggctgcaccatctgtt

SEQ ID NO: 572807 - DNA, 497 bp, Homo sapiens; identical to SEQ ID NO: 535286
  misc_feature: HIJSMM301BGHJM.18.59.F04.1.454.light.4.raw

SEQ ID NO: 572808 - DNA, 443 bp, Homo sapiens
  misc_feature: HIJSMM301DGF14.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtgtctat

SEQ ID NO: 572809 - DNA, 521 bp, Homo sapiens; identical to SEQ ID NO: 538715
  misc_feature: HIJSMM301DH6EW.27.23.C01.1.454.light.4.raw

SEQ ID NO: 572810 - DNA, 486 bp, Homo sapiens; identical to SEQ ID NO: 543773
  misc_feature: HIJSMM301ALTQ4.43.50.E06.1.454.light.4.raw

SEQ ID NO: 572811 - DNA, 486 bp, Homo sapiens; identical to SEQ ID NO: 535385
  misc_feature: HIJSMM301BODLK.19.71.G05.1.454.light.4.raw

SEQ ID NO: 572812 - DNA, 501 bp, Homo sapiens
  misc_feature: HIJSMM301C6WEU.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgaagaggctgattattactgcaggtcatatacaatcagcaacacttatgtcttcgggactgggaccaagatcaccgtcctaggtcagcccaaggccaacccactgtca

SEQ ID NO: 572813 - DNA, 483 bp, Homo sapiens; identical to SEQ ID NO: 536037
  misc_feature: HIJSMM301EET8B.5.39.D06.1.454.light.4.raw

SEQ ID NO: 572814 - DNA, 508 bp, Homo sapiens; identical to SEQ ID NO: 540640
  misc_feature: HIJSMM301A6ODT.5.60.F05.1.454.light.4.raw

SEQ ID NO: 572815 - DNA, 486 bp, Homo sapiens
  misc_feature: HIJSMM301DIWSE.26.23.C01.1.454.light.4.raw
  modified_base (391)..(391): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggacnctgcaacttattactgccaacaatatgatatttattctccagcgttcggccaggggaccaaggtggaagtcaagcgaactgtggctgcaccatct

SEQ ID NO: 572816 - DNA, 489 bp, Homo sapiens
  misc_feature: HIJSMM301DBNZE.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatcttccccacctttcggccctgggaccaaagtaggataatcaaacgaactgtggctgcaccatctgt

SEQ ID NO: 572817 - DNA, 483 bp, Homo sapiens
  misc_feature: HIJSMM301DEFR0.48.79.H02.1.454.light.4.raw
agtatacatacacgaccggtgctcgatttagtgtcacacgaagggaaaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggttattactgcatgcaagctctacaaactcctcgggcgttggccaagggaccaaggtggaatacaacgaaa

SEQ ID NO: 572818 - DNA, 493 bp, Homo sapiens; identical to SEQ ID NO: 535745
  misc_feature: HIJSMM301BHIXJ.47.78.H01.1.454.light.4.raw

SEQ ID NO: 572819 - DNA, 519 bp, Homo sapiens
  misc_feature: HIJSMM301C997U.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatcctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccgggtccgaggatgaggctgattattactgtgcagcatggggatgacagcctgagtggtccttgggtgttcggcggagggaccaagctgaccgtcctaagtcagcccaaggctggccccctcggtcactctgttcccaccctcctcg

SEQ ID NO: 572820 - DNA, 509 bp, Homo sapiens; identical to SEQ ID NO: 543772
  misc_feature: HIJSMM301DQC75.2.21.B10.1.454.light.4.raw

SEQ ID NO: 572821 - DNA, 499 bp, Homo sapiens
  misc_feature: HIJSMM301CN5JZ.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgttataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 572822 - DNA, 506 bp, Homo sapiens
  misc_feature: HIJSMM301CYNAC.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggccgtccgggggccacgtttcggccctgggaccaaattgagatacaaacgaactgtggctgcaccatctgtcttcatcttcccgcc

SEQ ID NO: 572823 - DNA, 494 bp, Homo sapiens; identical to SEQ ID NO: 535828
  misc_feature: HIJSMM301EXQFX.3.36.D03.1.454.light.4.raw

SEQ ID NO: 572824 - DNA, 509 bp, Homo sapiens; identical to SEQ ID NO: 535670
  misc_feature: HIJSMM301ED9BS.47.23.C01.1.454.light.4.raw

SEQ ID NO: 572825 - DNA, 477 bp, Homo sapiens
  misc_feature: HIJSMM301CGMDW.40.23.C01.1.454.light.4.raw
tctagcgactcacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttcggcggagggccaagctgaccgtcctaagtcagacccg

SEQ ID NO: 572826 - DNA, 506 bp, Homo sapiens
  misc_feature: HIJSMM301BV9BT.11.57.F02.1.454.light.4.raw
  modified_base (476)..(476): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccagggaccaaggtgaagtcaagcgaactgnggctgcaccatctgtcttcatcttcccgcc

SEQ ID NO: 572827 - DNA, 490 bp, Homo sapiens; identical to SEQ ID NO: 541974
  misc_feature: HIJSMM301BR1QH.22.65.F10.1.454.light.4.raw

SEQ ID NO: 572828 - DNA, 496 bp, Homo sapiens
  misc_feature: HIJSMM301EBW9G.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggagatcaaacgaactgtggctgcaccatctgtcttcattcc

SEQ ID NO: 572829 - DNA, 502 bp, Homo sapiens; identical to SEQ ID NO: 543936
  misc_feature: HIJSMM301B1YCG.15.1.A01.1.454.light.4.raw

SEQ ID NO: 572830 - DNA, 486 bp, Homo sapiens; identical to SEQ ID NO: 535043
  misc_feature: HIJSMM301E17GJ.46.35.D02.1.454.light.4.raw

SEQ ID NO: 572831 - DNA, 497 bp, Homo sapiens
  misc_feature: HIJSMM301BYO7L.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgcgtcactttcggcgggggaccgaaggtggagttcaaacgaactagtggctgcaccatctgtcttcatt

SEQ ID NO: 572832 - DNA, 492 bp, Homo sapiens
  misc_feature: HIJSMM301C8LB1.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggtccaggggaccaagctggagatcaaacgaactgt

SEQ ID NO: 572833 - DNA, 384 bp, Homo sapiens
  misc_feature: HIJSMM301AGELV.48.37.D04.1.454.light.4.raw
agtatacatacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 572834 - DNA, 473 bp, Homo sapiens
  misc_feature: HIJSMM301DB55W.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccaagtggatgtcaacgaactgtggctgcaca

SEQ ID NO: 572835 - DNA, 524 bp, Homo sapiens
  misc_feature: HIJSMM301BOMID.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggaccgaaacgtaggaaagtacaaacgaaactagtggcgtgtcgaccactctgtcttctactcttcccgtcccact

SEQ ID NO: 572836 - DNA, 444 bp, Homo sapiens
  misc_feature: HIJSMM301C94KB.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggtcccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctcgacacgcgag

SEQ ID NO: 572837 - DNA, 497 bp, Homo sapiens
  misc_feature: HIJSMM301BDDFX.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtacaaacaccttcggccgaagggacacgactggagattaaaggaactgtggctgcacatctgtcttcatccttccccg

SEQ ID NO: 572838 - DNA, 464 bp, Homo sapiens; identical to SEQ ID NO: 536640
  misc_feature: HIJSMM301EZGVW.26.78.H01.1.454.light.4.raw

SEQ ID NO: 572839 - DNA, 487 bp, Homo sapiens
  misc_feature: HIJSMM301B32YS.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctcgccccctcggtcta

SEQ ID NO: 572840 - DNA, 503 bp, Homo sapiens
  misc_feature: HIJSMM301A3DRC.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactagtggctgcaccatctgtcttcat

SEQ ID NO: 572841 - DNA, 496 bp, Homo sapiens
  misc_feature: HIJSMM301BRH75.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccgaaggtaggaaagtacaaacgaactagtggctgcaccatctgtt

SEQ ID NO: 572842 - DNA, 485 bp, Homo sapiens; identical to SEQ ID NO: 539576
  misc_feature: HIJSMM301CFDUQ.4.57.F02.1.454.light.4.raw

SEQ ID NO: 572843 - DNA, 493 bp, Homo sapiens; identical to SEQ ID NO: 537239
  misc_feature: HIJSMM301EY7LD.49.66.F11.1.454.light.4.raw

SEQ ID NO: 572844 - DNA, 501 bp, Homo sapiens
  misc_feature: HIJSMM301B1MMB.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggaccagggtgaaatcagacgaactgtgctgcaccat

SEQ ID NO: 572845 - DNA, 496 bp, Homo sapiens; identical to SEQ ID NO: 535224
  misc_feature: HIJSMM301DPXW3.22.57.F02.1.454.light.4.raw

SEQ ID NO: 572846 - DNA, 486 bp, Homo sapiens; identical to SEQ ID NO: 535385
  misc_feature: HIJSMM301A28FR.19.71.G05.1.454.light.4.raw

SEQ ID NO: 572847 - DNA, 483 bp, Homo sapiens
  misc_feature: HIJSMM301D6N3W.17.39.D06.1.454.light.4.raw
cgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgtcggccaacgggaccaaggtaggaaatacaaacgaactgtgg

SEQ ID NO: 572848 - DNA, 504 bp, Homo sapiens
  misc_feature: HIJSMM301A4VA6.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgacgtcctaggtcagcccaaggctgccccctcggtcactctcg

SEQ ID NO: 572849 - DNA, 511 bp, Homo sapiens; identical to SEQ ID NO: 547416
  misc_feature: HIJSMM301DDD0S.51.27.C05.1.454.light.4.raw

SEQ ID NO: 572850 - DNA, 506 bp, Homo sapiens
  misc_feature: HIJSMM301DY6A2.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaaggctgcccccg

SEQ ID NO: 572851 - DNA, 500 bp, Homo sapiens; identical to SEQ ID NO: 553383
  misc_feature: HIJSMM301AJTSV.18.11.A11.1.454.light.4.raw

SEQ ID NO: 572852 - DNA, 501 bp, Homo sapiens
  misc_feature: HIJSMM301DDFWU.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttcccg

SEQ ID NO: 572853 - DNA, 514 bp, Homo sapiens; identical to SEQ ID NO: 541502
  misc_feature: HIJSMM301EAZTW.15.34.D01.1.454.light.4.raw

SEQ ID NO: 572854 - DNA, 504 bp, Homo sapiens; identical to SEQ ID NO: 537659
  misc_feature: HIJSMM301D99PU.13.55.E11.1.454.light.4.raw

SEQ ID NO: 572855 - DNA, 502 bp, Homo sapiens; identical to SEQ ID NO: 536604
  misc_feature: HIJSMM301ATCHK.27.78.H01.1.454.light.4.raw

SEQ ID NO: 572856 - DNA, 453 bp, Homo sapiens
  misc_feature: HIJSMM301A1AQU.52.72.G06.1.454.light.4.raw
cgcagtacgacacgaccggtgctcgatttagctacgactgcaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctcgccccctcggtcactctcgttcccgccctcctctatacgatcg

SEQ ID NO: 572857 - DNA, 466 bp, Homo sapiens
  misc_feature: HIJSMM301CQ127.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtaccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccaagggaccaaggtggaaatcaaacgaa

SEQ ID NO: 572858 - DNA, 488 bp, Homo sapiens; identical to SEQ ID NO: 535081
  misc_feature: HIJSMM301C3J5J.26.23.C01.1.454.light.4.raw

SEQ ID NO: 572859 - DNA, 494 bp, Homo sapiens; identical to SEQ ID NO: 538747
  misc_feature: HIJSMM301DTVV6.22.86.H09.1.454.light.4.raw

SEQ ID NO: 572860 - DNA, 492 bp, Homo sapiens
  misc_feature: HIJSMM301AXP0C.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggtcttatgtcttcgcaactgggaccaaggtcaccgtcctaggtcagcccaaggccaaccccactgtcactc

SEQ ID NO: 572861 - DNA, 500 bp, Homo sapiens; identical to SEQ ID NO: 540219
  misc_feature: HIJSMM301A0BNI.43.34.D01.1.454.light.4.raw

SEQ ID NO: 572862 - DNA, 504 bp, Homo sapiens
  misc_feature: HIJSMM301CH2MW.43.34.D01.1.454.light.4.raw
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcaggtagttacacttatgtcttcggaattgggacgtacggtcaccgtcctaggtcagcccaaggcccaaccccta

SEQ ID NO: 572863 - DNA, 513 bp, Homo sapiens
  misc_feature: HIJSMM301DSG7K.49.15.B04.1.454.light.4.raw
agtcgagagacacgaccggtgctcgatttagacagtatatatccgcgggcacgaccggtgctcgatttagtcacgcgagaaagggaaagggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccacgggcccctggcatcccagccaggttcagtggcagtgggtctgggacagacttcactctcaccatcagcagcttagagcctgaagtattttgctagtttattacttgtcagcagcgtatcaccgggatccaccttcggccaacgggacccgactggagattaagcgaa

SEQ ID NO: 572864 - DNA, 489 bp, Homo sapiens
  misc_feature: HIJSMM301DE9KN.52.13.B02.1.454.light.4.raw
  modified_base (433)..(433): a, c, t, g, unknown or other
cgcagtacgacacgaccggtgctcgatttagtctagcgacttccgcggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattgggggataaatatgtttcctggtatcagcagaagccaggccagtcccctgcgttggtcatctatcaagataccaagaggcgctcagggatccctgagcgattctctggctccaactctggggacacagccactctgaccatcagcgggacccagactctggatgaggctgactattactgtcaggcgtgggacaggcagcacgggggtnttcggcggagggaccaagctgaccgtcctaggtcagcccaaggctgccccctcggt

SEQ ID NO: 572865 - DNA, 528 bp, Homo sapiens
  misc_feature: HIJSMM301ELQST.9.12.B01.1.454.light.4.raw
tgatacgtctcacgaccggtgctcgatttagtagtgtagattccgcggggacaacgaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtcctaacgggaaccgaacggtaggtaaagtacaaacgaaacctagtaggcgttcggcaccaactctcgttcttctatctttcccccg

SEQ ID NO: 572866 - DNA, 496 bp, Homo sapiens
  misc_feature: HIJSMM301A6WWE.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatacaaacgaaactgtggctgcaccatctgtcttcat

SEQ ID NO: 572867 - DNA, 504 bp, Homo sapiens; identical to SEQ ID NO: 540538
  misc_feature: HIJSMM301BOFUL.7.71.G05.1.454.light.4.raw

SEQ ID NO: 572868 - DNA, 488 bp, Homo sapiens; identical to SEQ ID NO: 558711
  misc_feature: HIJSMM301BT8PU.40.83.H06.1.454.light.4.raw

SEQ ID NO: 572869 - DNA, 501 bp, Homo sapiens
  misc_feature: HIJSMM301CILC5.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacgcctccctgaccatctctgggctccaggctgaggacgaggctgattattactgcagctcatatacaagcaccagcactctctatgtcttcggaactgggaccaaggtcaccgtcctaggtcagcccaaggccaaccca

SEQ ID NO: 572870 - DNA, 493 bp, Homo sapiens
  misc_feature: HIJSMM301D1MTY.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcacatctgt

SEQ ID NO: 572871 - DNA, 503 bp, Homo sapiens
  misc_feature: HIJSMM301AWATE.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccaaggtaggaaatcaaacgaactagtggctgcaccatctgtcttcatcttccccg

SEQ ID NO: 572872 - DNA, 501 bp, Homo sapiens
  misc_feature: HIJSMM301AUZMR.9.21.B10.1.454.light.4.raw
tgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagtatattcggcggagggaccagggctgaccgtcctgagtcagcccaaggctgccccctc

SEQ ID NO: 572873 - DNA, 503 bp, Homo sapiens; identical to SEQ ID NO: 539578
  misc_feature: HIJSMM301EHTGJ.48.8.A08.1.454.light.4.raw

SEQ ID NO: 572874 - DNA, 492 bp, Homo sapiens
  misc_feature: HIJSMM301AJNXV.5.64.F09.1.454.light.4.raw
atcagacacgcacgaccggtgctcgatttagcgcgtatacaaggggcagactcagtcaggacacagcatggacatgagggtccccgctcagctcctggggctcctgctgctctggctcccaggtgccaaatgtgacatccaaatgacccagtctcctgccaccctgtctgcttttgtgggagacagaatcaccatcacttgccgggccagtcagactattagtacctggttggcctggtatcagcaaaaccagggaaagccctcgtctcctgatctttgatgcctccagtttagaaactggggtcccatcaaggttcagcggccgtggatctgggacagaattcactctcaccgtcaacggcctgcagcctgatgattttgcaacttattactgccatcagtatagtagttttccattcaccttcggccctgggaccaaagtggatctcagtcgaactgtggctgcaccatctgtcttcatcttcccgccta

SEQ ID NO: 572875 - DNA, 464 bp, Homo sapiens; identical to SEQ ID NO: 568856
  misc_feature: HIJSMM301EJY7F.11.73.G07.1.454.light.4.raw

SEQ ID NO: 572876 - DNA, 487 bp, Homo sapiens; identical to SEQ ID NO: 537573
  misc_feature: HIJSMM301ANL6M.3.10.A10.1.454.light.4.raw

SEQ ID NO: 572877 - DNA, 484 bp, Homo sapiens; identical to SEQ ID NO: 535400
  misc_feature: HIJSMM301ALUOX.46.26.C04.1.454.light.4.raw

SEQ ID NO: 572878 - DNA, 518 bp, Homo sapiens; identical to SEQ ID NO: 539372
  misc_feature: HIJSMM301AE1YH.7.86.H09.1.454.light.4.raw

SEQ ID NO: 572879 - DNA, 484 bp, Homo sapiens; identical to SEQ ID NO: 535400
  misc_feature: HIJSMM301DBQMO.46.26.C04.1.454.light.4.raw

SEQ ID NO: 572880 - DNA, 478 bp, Homo sapiens; identical to SEQ ID NO: 535129
  misc_feature: HIJSMM301EURD1.11.11.A11.1.454.light.4.raw

SEQ ID NO: 572881 - DNA, 480 bp, Homo sapiens; identical to SEQ ID NO: 568031
  misc_feature: HIJSMM301EXX6Y.13.48.E04.1.454.light.4.raw

SEQ ID NO: 572882 - DNA, 494 bp, Homo sapiens; identical to SEQ ID NO: 534992
  misc_feature: HIJSMM301D8MG3.9.1.A01.1.454.light.4.raw

SEQ ID NO: 572883 - DNA, 502 bp, Homo sapiens; identical to SEQ ID NO: 537363
  misc_feature: HIJSMM301C3VLS.18.23.C01.1.454.light.4.raw

SEQ ID NO: 572884 - DNA, 490 bp, Homo sapiens
  misc_feature: HIJSMM301B5EK3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatcccagatgacccagtcgtccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttca

SEQ ID NO: 572885 - DNA, 493 bp, Homo sapiens; identical to SEQ ID NO: 549949
  misc_feature: HIJSMM301ARAOT.5.35.D02.1.454.light.4.raw

SEQ ID NO: 572886 - DNA, 511 bp, Homo sapiens
  misc_feature: HIJSMM301DE7LA.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 572887 - DNA, 483 bp, Homo sapiens; identical to SEQ ID NO: 536691
  misc_feature: HIJSMM301CXLVB.17.26.C04.1.454.light.4.raw

SEQ ID NO: 572888 - DNA, 352 bp, Homo sapiens
  misc_feature: HIJSMM301DWFYV.8.67.G01.1.454.light.4.raw
ctcgcgtgtccacgaccggtgctcgattttagagtatacatattgggtttggggggcttttcctgggctcctgctacgtctggctccgaggtggccagatggtccgacatccagactgggacccagttctccatcctcccgtgtcctggcttctataggaggacagagtccaccatcaccttgtccgggccaagtccacgaccattagctaccttttttaaattgggtagtacaacaggagcccaacggaaaagcccccaaacttccgtggatttatggtagactataccattttacgtactaaagttgggtcccaagtcgaaggttacaggtacggccaaggtcggacttc

SEQ ID NO: 572889 - DNA, 493 bp, Homo sapiens; identical to SEQ ID NO: 536289
  misc_feature: HIJSMM301APMYK.14.5.A05.1.454.light.4.raw

SEQ ID NO: 572890 - DNA, 490 bp, Homo sapiens
  misc_feature: HIJSMM301CWL42.47.53.E09.1.454.light.4.raw
agctcacgtacacgaccggtgctcgatttagagagagtgtgttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccgggtccctgacaggttcagtggcagtggatcaggcacagattttacgctgaaaatcagtagggtggaggctgaggatgttggggtttattactgcatgcaagttctacaaacttcctacacttttgggccaggggaccaagctggagatcaaacgaactgtgg

SEQ ID NO: 572891 - DNA, 444 bp, Homo sapiens; identical to SEQ ID NO: 535192
  misc_feature: HIJSMM301D21O0.5.9.A09.1.454.light.4.raw

SEQ ID NO: 572892 - DNA, 512 bp, Homo sapiens
  misc_feature: HIJSMM301EMGH0.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccaaagtaggatatcaaacgaacctagtggctgcaccatctgtcttcta

SEQ ID NO: 572893 - DNA, 489 bp, Homo sapiens; identical to SEQ ID NO: 536663
  misc_feature: HIJSMM301EMW7N.16.72.G06.1.454.light.4.raw

SEQ ID NO: 572894 - DNA, 389 bp, Homo sapiens; identical to SEQ ID NO: 558170
  misc_feature: HIJSMM301ETE7T.21.40.D07.1.454.light.4.raw

SEQ ID NO: 572895 - DNA, 501 bp, Homo sapiens
  misc_feature: HIJSMM301C2EXA.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatattttctatcctccgtggacttcggccaagggaccagggtggaaatcagacgaactgtggctgcaccat

SEQ ID NO: 572896 - DNA, 490 bp, Homo sapiens
  misc_feature: HIJSMM301BC3ZC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatcccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 572897 - DNA, 481 bp, Homo sapiens
  misc_feature: HIJSMM301ERHY5.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggtctgttcggcggcgggacc

SEQ ID NO: 572898 - DNA, 475 bp, Homo sapiens
  misc_feature: HIJSMM301CDJ62.47.3.A03.1.454.light.4.raw
agctcacgtacacgaccggtgctcgatttagagagcgtcacaggaggagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtcccatcaaggttcagcggcagtaggtctgggacagagttcactctcactatcagcggcctgcagcctgaagattctgcaacttattactgtctccagtatgatgcttaccctcggactttcggccaagggaccaaggtggaaatcaaacgaactagt

SEQ ID NO: 572899 - DNA, 494 bp, Homo sapiens; identical to SEQ ID NO: 536974
  misc_feature: HIJSMM301DLYIQ.16.86.H09.1.454.light.4.raw

SEQ ID NO: 572900 - DNA, 495 bp, Homo sapiens
  misc_feature: HIJSMM301AHGSA.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcacctatcagcagactggagcctgaggattttgcagtgtattactgtcagcagtatcataggtcaaacaccttcggccaaggacacgactggagattaaaggaactagtggctgcaccatctgtcttcatcttccccg

SEQ ID NO: 572901 - DNA, 493 bp, Homo sapiens; identical to SEQ ID NO: 544666
  misc_feature: HIJSMM301AT3OW.12.23.C01.1.454.light.4.raw

SEQ ID NO: 572902 - DNA, 472 bp, Homo sapiens
  misc_feature: HIJSMM301CRS48.13.76.G10.1.454.light.4.raw
tcacgtactacacgaccggtgctcgatttagtcactcatacagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctggaactcagccactctgaccatcagcgggacccaggcctatggatgaggctgactattactgtcaggcgtggacagcagcactcgcccgctatgtctcggactgggaccaggtcacgtctaagtcacgacccg

SEQ ID NO: 572903 - DNA, 494 bp, Homo sapiens; identical to SEQ ID NO: 534994
  misc_feature: HIJSMM301BYEF9.27.78.H01.1.454.light.4.raw

SEQ ID NO: 572904 - DNA, 454 bp, Homo sapiens; identical to SEQ ID NO: 534964
  misc_feature: HIJSMM301BH7N5.19.86.H09.1.454.light.4.raw

SEQ ID NO: 572905 - DNA, 507 bp, Homo sapiens; identical to SEQ ID NO: 561702
  misc_feature: HIJSMM301DZCGT.5.24.C02.1.454.light.4.raw

SEQ ID NO: 572906 - DNA, 486 bp, Homo sapiens; identical to SEQ ID NO: 557950
  misc_feature: HIJSMM301A02MN.15.1.A01.1.454.light.4.raw

SEQ ID NO: 572907 - DNA, 515 bp, Homo sapiens; identical to SEQ ID NO: 538404
  misc_feature: HIJSMM301DM8HU.22.30.C08.1.454.light.4.raw

SEQ ID NO: 572908 - DNA, 487 bp, Homo sapiens; identical to SEQ ID NO: 535583
  misc_feature: HIJSMM301BFGV4.22.73.G07.1.454.light.4.raw

SEQ ID NO: 572909 - DNA, 505 bp, Homo sapiens
  misc_feature: HIJSMM301C5CW5.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactt

SEQ ID NO: 572910 - DNA, 479 bp, Homo sapiens; identical to SEQ ID NO: 537163
  misc_feature: HIJSMM301BMHPO.13.73.G07.1.454.light.4.raw

SEQ ID NO: 572911 - DNA, 491 bp, Homo sapiens; identical to SEQ ID NO: 563114
  misc_feature: HIJSMM301DFQIN.40.57.F02.1.454.light.4.raw

SEQ ID NO: 572912 - DNA, 484 bp, Homo sapiens; identical to SEQ ID NO: 535441
  misc_feature: HIJSMM301EQSR6.26.60.F05.1.454.light.4.raw

SEQ ID NO: 572913 - DNA, 500 bp, Homo sapiens
  misc_feature: HIJSMM301CXU2F.48.58.F03.1.454.light.4.raw
agtatacatacacgaccggtgctcgatttagtctgatcgagaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattacgtgtcatcagacttttagtttacgtcggaccttcggccaagggacacgactggagattaaacgactgtgctgcaccatctgtcttcatcttccccg

SEQ ID NO: 572914 - DNA, 499 bp, Homo sapiens; identical to SEQ ID NO: 551769
  misc_feature: HIJSMM301DOPGL.43.34.D01.1.454.light.4.raw

SEQ ID NO: 572915 - DNA, 511 bp, Homo sapiens
  misc_feature: HIJSMM301AH499.8.42.D09.1.454.light.4.raw
ctcgcgtgtccacgaccggtgctcgatttagacacatacgcaggggaaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctggtcactctgttcccgccctcc

SEQ ID NO: 572916 - DNA, 447 bp, Homo sapiens; identical to SEQ ID NO: 535882
  misc_feature: HIJSMM301EHVIA.18.9.A09.1.454.light.4.raw
  modified_base (429)..(429): a, c, t, g, unknown or other

SEQ ID NO: 572917 - DNA, 486 bp, Homo sapiens
  misc_feature: HIJSMM301CBFBV.48.73.G07.1.454.light.4.raw
agtatacatacacgaccggtgctcgatttagctctacgctcagggcacgaccggtgctcgatttagtatctgatagttgggtttggggggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactggttcggcggagggacc

SEQ ID NO: 572918 - DNA, 489 bp, Homo sapiens
  misc_feature: HIJSMM301DXDJ8.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnacctttcggcggagggaccaaggcggagatcagacgaactgtggctgcaccatctgtcttca

SEQ ID NO: 572919 - DNA, 483 bp, Homo sapiens; identical to SEQ ID NO: 543117
  misc_feature: HIJSMM301EMFR2.4.27.C05.1.454.light.4.raw

SEQ ID NO: 572920 - DNA, 504 bp, Homo sapiens; identical to SEQ ID NO: 535495
  misc_feature: HIJSMM301C7RBJ.14.86.H09.1.454.light.4.raw

SEQ ID NO: 572921 - DNA, 456 bp, Homo sapiens
  misc_feature: HIJSMM301CIXOJ.19.71.G05.1.454.light.4.raw
tactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtttcggccaagggaccaaggtggatatcagacgaactgtggctgcaccatctgtcttcatcttcccgccatctgacacgagagta

SEQ ID NO: 572922 - DNA, 508 bp, Homo sapiens; identical to SEQ ID NO: 537871
  misc_feature: HIJSMM301C7T3J.8.33.C11.1.454.light.4.raw

SEQ ID NO: 572923 - DNA, 500 bp, Homo sapiens; identical to SEQ ID NO: 540012
  misc_feature: HIJSMM301D1C5R.52.34.D01.1.454.light.4.raw

SEQ ID NO: 572924 - DNA, 502 bp, Homo sapiens
  misc_feature: HIJSMM301ALNI9.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttcaatcgcttctctggctccaagtctggcaacacggcctcctgaccatctctgggctccaggctgaggacgaggctgattattactgcagctcatatacaagcagcagcactcaagtcttcggaactggaccaaggtcaccgtcctaggtcagcccaaggcccaaccccatgtca

SEQ ID NO: 572925 - DNA, 503 bp, Homo sapiens
  misc_feature: HIJSMM301ECC00.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggggaccaaggtggagttcaaacgaactgtggctgcaccatctgtcttcatcttcccg

SEQ ID NO: 572926 - DNA, 481 bp, Homo sapiens
  misc_feature: HIJSMM301CIJHZ.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggactctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggctgttcggcggcggaccaa

SEQ ID NO: 572927 - DNA, 499 bp, Homo sapiens
  misc_feature: HIJSMM301BZU90.43.87.H10.1.454.light.4.raw
tgtgagtagtcacgaccggtgctcgatttagcagtactgcgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccca

SEQ ID NO: 572928 - DNA, 501 bp, Homo sapiens; identical to SEQ ID NO: 536142
  misc_feature: HIJSMM301D40BZ.15.1.A01.1.454.light.4.raw

SEQ ID NO: 572929 - DNA, 480 bp, Homo sapiens; identical to SEQ ID NO: 559070
  misc_feature: HIJSMM301BBZ41.21.25.C03.1.454.light.4.raw

SEQ ID NO: 572930 - DNA, 502 bp, Homo sapiens; identical to SEQ ID NO: 537363
  misc_feature: HIJSMM301BUIP5.18.23.C01.1.454.light.4.raw

SEQ ID NO: 572931 - DNA, 377 bp, Homo sapiens; identical to SEQ ID NO: 536071
  misc_feature: HIJSMM301D3VZD.40.9.A09.1.454.light.4.raw

SEQ ID NO: 572932 - DNA, 496 bp, Homo sapiens; identical to SEQ ID NO: 540287
  misc_feature: HIJSMM301A2SPI.40.11.A11.1.454.light.4.raw

SEQ ID NO: 572933 - DNA, 473 bp, Homo sapiens; identical to SEQ ID NO: 569938
  misc_feature: HIJSMM301DGAYE.18.76.G10.1.454.light.4.raw

SEQ ID NO: 572934 - DNA, 488 bp, Homo sapiens
  misc_feature: HIJSMM301BEWED.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctcggtcactttcggcggagggaccaaggtggagatcaaacgaactgtggctgcaccat

SEQ ID NO: 572935 - DNA, 488 bp, Homo sapiens; identical to SEQ ID NO: 545567
  misc_feature: HIJSMM301A8BVX.47.38.D05.1.454.light.4.raw

SEQ ID NO: 572936 - DNA, 480 bp, Homo sapiens
  misc_feature: HIJSMM301AXRH1.12.10.A10.1.454.light.4.raw
atacgacgtacacgaccggtgctcgatttagcgtcgatctcagggggcgaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggccctgggaccacagtagatatcaaacgaactgtggctgcacc

SEQ ID NO: 572937 - DNA, 481 bp, Homo sapiens
  misc_feature: HIJSMM301A2JAI.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttgg

SEQ ID NO: 572938 - DNA, 518 bp, Homo sapiens; identical to SEQ ID NO: 542842
  misc_feature: HIJSMM301AKLYK.8.87.H10.1.454.light.4.raw

SEQ ID NO: 572939 - DNA, 496 bp, Homo sapiens
  misc_feature: HIJSMM301CYCOY.48.59.F04.1.454.light.4.raw
agtatacatacacgaccggtgctcgatttagtacacacacttagggattgggggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 572940 - DNA, 491 bp, Homo sapiens
  misc_feature: HIJSMM301EFGOF.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcgagggacctggctgaccgtcctacgtcagccaac

SEQ ID NO: 572941 - DNA, 470 bp, Homo sapiens; identical to SEQ ID NO: 535302
  misc_feature: HIJSMM301A0XE5.13.76.G10.1.454.light.4.raw

SEQ ID NO: 572942 - DNA, 454 bp, Homo sapiens; identical to SEQ ID NO: 535005
  misc_feature: HIJSMM301CN1K1.19.86.H09.1.454.light.4.raw

SEQ ID NO: 572943 - DNA, 478 bp, Homo sapiens; identical to SEQ ID NO: 541928
  misc_feature: HIJSMM301DLUAI.7.76.G10.1.454.light.4.raw

SEQ ID NO: 572944 - DNA, 488 bp, Homo sapiens
  misc_feature: HIJSMM301AWE03.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactagtggctgcaccatctgtt

SEQ ID NO: 572945 - DNA, 492 bp, Homo sapiens
  misc_feature: HIJSMM301CCXPX.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattacttgcatgcaagctctacaaactccttacacttttggccaggggaccaagctggagatcaaacgaactgt

SEQ ID NO: 572946 - DNA, 487 bp, Homo sapiens; identical to SEQ ID NO: 537573
  misc_feature: HIJSMM301ARHXF.3.10.A10.1.454.light.4.raw

SEQ ID NO: 572947 - DNA, 503 bp, Homo sapiens; identical to SEQ ID NO: 538583
  misc_feature: HIJSMM301AXZ1T.15.59.F04.1.454.light.4.raw

SEQ ID NO: 572948 - DNA, 304 bp, Homo sapiens
  misc_feature: HIJSMM301EI1EO.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcgagagggtcaccatatcttgttctggaaacagctccggcatctcaactaaacatttttgtctggtaccagcaattcccaggatcggccccccgacctctcca

SEQ ID NO: 572949 - DNA, 487 bp, Homo sapiens
  misc_feature: HIJSMM301CCS4H.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtctaggtcagaccccg

SEQ ID NO: 572950 - DNA, 494 bp, Homo sapiens; identical to SEQ ID NO: 537003
  misc_feature: HIJSMM301C1OTO.10.79.H02.1.454.light.4.raw

SEQ ID NO: 572951 - DNA, 493 bp, Homo sapiens; identical to SEQ ID NO: 536969
  misc_feature: HIJSMM301AZ1Q7.27.78.H01.1.454.light.4.raw

SEQ ID NO: 572952 - DNA, 500 bp, Homo sapiens; identical to SEQ ID NO: 539563
  misc_feature: HIJSMM301B05MY.8.2.A02.1.454.light.4.raw

SEQ ID NO: 572953 - DNA, 484 bp, Homo sapiens; identical to SEQ ID NO: 535211
  misc_feature: HIJSMM301EK0EH.47.46.E02.1.454.light.4.raw

SEQ ID NO: 572954 - DNA, 489 bp, Homo sapiens; identical to SEQ ID NO: 543840
  misc_feature: HIJSMM301C2F9M.12.88.H11.1.454.light.4.raw

SEQ ID NO: 572955 - DNA, 494 bp, Homo sapiens; identical to SEQ ID NO: 534994
  misc_feature: HIJSMM301C9WOY.27.78.H01.1.454.light.4.raw

SEQ ID NO: 572956 - DNA, 491 bp, Homo sapiens
  misc_feature: HIJSMM301BNAHN.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaactgtgg

SEQ ID NO: 572957 - DNA, 474 bp, Homo sapiens; identical to SEQ ID NO: 558221
  misc_feature: HIJSMM301BP6TU.12.49.E05.1.454.light.4.raw

SEQ ID NO: 572958 - DNA, 444 bp, Homo sapiens; identical to SEQ ID NO: 535027
  misc_feature: HIJSMM301EJOTV.8.73.G07.1.454.light.4.raw

SEQ ID NO: 572959 - DNA, 521 bp, Homo sapiens; identical to SEQ ID NO: 539470
  misc_feature: HIJSMM301ARVPH.27.23.C01.1.454.light.4.raw

SEQ ID NO: 572960 - DNA, 490 bp, Homo sapiens
  misc_feature: HIJSMM301CVL8G.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggaggatcaaacgaactgt

SEQ ID NO: 572961 - DNA, 496 bp, Homo sapiens
  misc_feature: HIJSMM301D8TNA.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgctagtttattactgtcagcagcgtagcaactccctcacgttcggcggagggaccaaggtggagatcaaacgaactgtggctgcaccatctgtcttcatcttcccgcc

SEQ ID NO: 572962 - DNA, 508 bp, Homo sapiens; identical to SEQ ID NO: 536388
  misc_feature: HIJSMM301C9E9J.11.57.F02.1.454.light.4.raw

SEQ ID NO: 572963 - DNA, 507 bp, Homo sapiens
  misc_feature: HIJSMM301AOL7H.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaagggaccaaggtggaattcaaccgaactagtggctgcaccatctgtcttcatcttcccg

SEQ ID NO: 572964 - DNA, 485 bp, Homo sapiens
  misc_feature: HIJSMM301BZB7T.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccacggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 572965 - DNA, 498 bp, Homo sapiens
  misc_feature: HIJSMM301A4GCH.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 572966 - DNA, 495 bp, Homo sapiens; identical to SEQ ID NO: 535007
  misc_feature: HIJSMM301CBLNF.22.5.A05.1.454.light.4.raw

SEQ ID NO: 572967 - DNA, 484 bp, Homo sapiens
  misc_feature: HIJSMM301BBD3N.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggtcctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 572968 - DNA, 509 bp, Homo sapiens; identical to SEQ ID NO: 544573
  misc_feature: HIJSMM301DT0PR.10.88.H11.1.454.light.4.raw

SEQ ID NO: 572969 - DNA, 495 bp, Homo sapiens; identical to SEQ ID NO: 535007
  misc_feature: HIJSMM301CQCK4.22.5.A05.1.454.light.4.raw

SEQ ID NO: 572970 - DNA, 496 bp, Homo sapiens; identical to SEQ ID NO: 537925
  misc_feature: HIJSMM301C088H.22.14.B03.1.454.light.4.raw

SEQ ID NO: 572971 - DNA, 489 bp, Homo sapiens; identical to SEQ ID NO: 535139
  misc_feature: HIJSMM301AN03B.14.55.E11.1.454.light.4.raw

SEQ ID NO: 572972 - DNA, 485 bp, Homo sapiens; identical to SEQ ID NO: 536576
  misc_feature: HIJSMM301EG4NW.46.35.D02.1.454.light.4.raw

SEQ ID NO: 572973 - DNA, 445 bp, Homo sapiens
  misc_feature: HIJSMM301AM121.5.9.A09.1.454.light.4.raw
atcagacacgcacgaccggtgctcgatttagcgagacgcgcagggtcctgggcccagtctgtggtgacgcagccgccctccgtttatggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctgagtcagcccaaggctgccccctcggtcactctgttccccaccctcctccgtgtctgat

SEQ ID NO: 572974 - DNA, 502 bp, Homo sapiens; identical to SEQ ID NO: 543913
  misc_feature: HIJSMM301DB8PH.18.26.C04.1.454.light.4.raw

SEQ ID NO: 572975 - DNA, 447 bp, Homo sapiens; identical to SEQ ID NO: 535020
  misc_feature: HIJSMM301CNU4E.18.9.A09.1.454.light.4.raw

SEQ ID NO: 572976 - DNA, 503 bp, Homo sapiens; identical to SEQ ID NO: 537189
  misc_feature: HIJSMM301BJ15C.19.85.H08.1.454.light.4.raw

SEQ ID NO: 572977 - DNA, 519 bp, Homo sapiens
  misc_feature: HIJSMM301DK3G3.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaagctgccccctcggtcactctgttcccacct

SEQ ID NO: 572978 - DNA, 497 bp, Homo sapiens; identical to SEQ ID NO: 546781
  misc_feature: HIJSMM301ALQ95.43.28.C06.1.454.light.4.raw

SEQ ID NO: 572979 - DNA, 503 bp, Homo sapiens; identical to SEQ ID NO: 538884
  misc_feature: HIJSMM301AW5K6.27.78.H01.1.454.light.4.raw

SEQ ID NO: 572980 - DNA, 495 bp, Homo sapiens; identical to SEQ ID NO: 566036
  misc_feature: HIJSMM301CPZUJ.16.78.H01.1.454.light.4.raw

SEQ ID NO: 572981 - DNA, 506 bp, Homo sapiens
  misc_feature: HIJSMM301AHLPK.48.73.G07.1.454.light.4.raw
agtatacatacacgaccggtgctcgatttagctctacgctcagggcacgaccggtgctcgatttagtagtgtagattccgcgggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacagcccccaaactcctcatttatgacaataataagcgaccctcaggaattcctgaccgattctctggctccaagtctggcacgtcagccaccctgggcatcaccggactccagactggggacgaggccgattattactgcggaacatgggataacagcccgagtggtggccgggtcttcggcggac

SEQ ID NO: 572982 - DNA, 498 bp, Homo sapiens; identical to SEQ ID NO: 553891
  misc_feature: HIJSMM301ASNKG.3.33.C11.1.454.light.4.raw

SEQ ID NO: 572983 - DNA, 491 bp, Homo sapiens
  misc_feature: HIJSMM301DSASA.13.5.A05.1.454.light.4.raw
tcacgtactacacgaccggtgctcgatttagatagatagacagggggagccacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgtgg

SEQ ID NO: 572984 - DNA, 486 bp, Homo sapiens; identical to SEQ ID NO: 536323
  misc_feature: HIJSMM301BURT6.10.2.A02.1.454.light.4.raw

SEQ ID NO: 572985 - DNA, 488 bp, Homo sapiens; identical to SEQ ID NO: 537260
  misc_feature: HIJSMM301DZG7T.47.70.G04.1.454.light.4.raw

SEQ ID NO: 572986 - DNA, 493 bp, Homo sapiens; identical to SEQ ID NO: 558407
  misc_feature: HIJSMM301A5939.18.11.A11.1.454.light.4.raw

SEQ ID NO: 572987 - DNA, 465 bp, Homo sapiens
  misc_feature: HIJSMM301AX8KK.51.11.A11.1.454.light.4.raw
cgatcgtatacacgaccggtgctcgatttagctacgactgcagggggcaggagtcagtcccaaccaggacacagcatggacatagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaa

SEQ ID NO: 572988 - DNA, 507 bp, Homo sapiens
  misc_feature: HIJSMM301BSNAH.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtctaggtcagcccaaggccaacccca

SEQ ID NO: 572989 - DNA, 499 bp, Homo sapiens; identical to SEQ ID NO: 551544
  misc_feature: HIJSMM301CV9H7.41.53.E09.1.454.light.4.raw

SEQ ID NO: 572990 - DNA, 492 bp, Homo sapiens; identical to SEQ ID NO: 550823
  misc_feature: HIJSMM301BSBH0.49.20.B09.1.454.light.4.raw

SEQ ID NO: 572991 - DNA, 488 bp, Homo sapiens; identical to SEQ ID NO: 540922
  misc_feature: HIJSMM301DUJZQ.14.55.E11.1.454.light.4.raw
  modified_base (427)..(427): a, c, t, g, unknown or other

SEQ ID NO: 572992 - DNA, 488 bp, Homo sapiens
  misc_feature: HIJSMM301CHA6X.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagcctggagatcaggcgaacg

SEQ ID NO: 572993 - DNA, 507 bp, Homo sapiens
  misc_feature: HIJSMM301DTPY3.14.3.A03.1.454.light.4.raw
cgtctagtaccacgaccggtgctcgatttagagagcgtcacaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcactcttcg

SEQ ID NO: 572994 - DNA, 496 bp, Homo sapiens; identical to SEQ ID NO: 537925
  misc_feature: HIJSMM301D5VYA.22.14.B03.1.454.light.4.raw

SEQ ID NO: 572995 - DNA, 501 bp, Homo sapiens
  misc_feature: HIJSMM301A44ND.8.2.A02.1.454.light.4.raw
ctcgcgtgtccacgaccggtgctcgatttagactcatctacagggggagggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggaaatcaaacgaactgtggctgcaccatctgtcttcatcttcccgccat

SEQ ID NO: 572996 - DNA, 493 bp, Homo sapiens; identical to SEQ ID NO: 535047
  misc_feature: HIJSMM301AV2C5.16.53.E09.1.454.light.4.raw

SEQ ID NO: 572997 - DNA, 489 bp, Homo sapiens; identical to SEQ ID NO: 535139
  misc_feature: HIJSMM301EI0PP.14.55.E11.1.454.light.4.raw

SEQ ID NO: 572998 - DNA, 487 bp, Homo sapiens
  misc_feature: HIJSMM301BPMY1.49.37.D04.1.454.light.4.raw
agtcgagagacacgaccggtgctcgatttagtagcatactgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccggggcagaggacgaggctgactattactgtcagtcatcagacagtagtggcacttctgtcgtattcggcggagggaccaagctgaccgtcctaggtcagcccaaggctcg

SEQ ID NO: 572999 - DNA, 466 bp, Homo sapiens
  misc_feature: HIJSMM301EK1WL.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtatagattgtgatgacccagactccagtctccttgtctctcacccctggagagcaggcctccatgtcctgcaggtctagtctgcgcctcctgcatagtgacggatgctccctttttgtattggtttctgcagagaggcaggccagtctccacaactcctgatctatgaagttgccacccggctctctggagtgccagatatgttcagtggctgcgggtcaggcacagatctcacactagaaaaacagccgggtggagagtgaccatgttggaacttata

SEQ ID NO: 573000 - DNA, 485 bp, Homo sapiens; identical to SEQ ID NO: 538533
  misc_feature: HIJSMM301AH5PB.47.78.H01.1.454.light.4.raw

SEQ ID NO: 573001 - DNA, 494 bp, Homo sapiens
  misc_feature: HIJSMM301ERVHH.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcaatttattactgtcagcagtataataactggttcctgctcactttcggcgggggaccgaaggtggagatcaaacgaactgtggctgcaccatctgtt

SEQ ID NO: 573002 - DNA, 491 bp, Homo sapiens; identical to SEQ ID NO: 542310
  misc_feature: HIJSMM301A7DY9.22.65.F10.1.454.light.4.raw

SEQ ID NO: 573003 - DNA, 513 bp, Homo sapiens
  misc_feature: HIJSMM301B1N91.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccccggacgttcgtccacggaccgaacgtacggaagtacaagacgaactacgtggcgtcgcaccactctgtcttctactcttccgt

SEQ ID NO: 573004 - DNA, 493 bp, Homo sapiens; identical to SEQ ID NO: 535047
  misc_feature: HIJSMM301DC8ES.16.53.E09.1.454.light.4.raw

SEQ ID NO: 573005 - DNA, 486 bp, Homo sapiens; identical to SEQ ID NO: 537617
  misc_feature: HIJSMM301EPVAE.10.53.E09.1.454.light.4.raw

SEQ ID NO: 573006 - DNA, 507 bp, Homo sapiens
  misc_feature: HIJSMM301B3ZG7.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggcgaggctgactattactgcctactctactttggtggtgctgtgctattcggcgagggaccaagctgaccgtcttaagtcagcccaaggctgccccctcggtcactctgttccca

SEQ ID NO: 573007 - DNA, 502 bp, Homo sapiens; identical to SEQ ID NO: 541971
  misc_feature: HIJSMM301CP5Q8.4.39.D06.1.454.light.4.raw

SEQ ID NO: 573008 - DNA, 495 bp, Homo sapiens; identical to SEQ ID NO: 557377
  misc_feature: HIJSMM301EU1GG.41.53.E09.1.454.light.4.raw

SEQ ID NO: 573009 - DNA, 472 bp, Homo sapiens; identical to SEQ ID NO: 537676
  misc_feature: HIJSMM301C569G.4.75.G09.1.454.light.4.raw

SEQ ID NO: 573010 - DNA, 486 bp, Homo sapiens
  misc_feature: HIJSMM301CPZVO.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccgaacggtggaactcaaacgaactgtggctgcaccatctgtcttcatcttcccgccatctgactagtctacg

SEQ ID NO: 573011 - DNA, 486 bp, Homo sapiens; identical to SEQ ID NO: 537144
  misc_feature: HIJSMM301CYKIP.46.35.D02.1.454.light.4.raw

SEQ ID NO: 573012 - DNA, 440 bp, Homo sapiens
  misc_feature: HIJSMM301EG5VL.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgattattactgcagctcatatacaagcagcagcactcaagtcttcggaactgggaccaaggtcaccgtcctaggtcagcccaaggccaacccactgtcactctgttcccgccctcctccatactcgta

SEQ ID NO: 573013 - DNA, 491 bp, Homo sapiens
  misc_feature: HIJSMM301CV1QW.17.86.H09.1.454.light.4.raw
  modified_base (482)..(482): a, c, t, g, unknown or other
cgtagactagcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagtgcttataactatgtctcctggtaccaacagcacccaggcaaggtccccaaagccatgatttatgaggtcagtaatcggccctcaggggtttctaatcgcttctctggctccaagtctggcaacacggcctccctcaccatctctggactccagcctgaggacgaggctgattattactgcatctcatttgtaagcagtagccttgtgttattcggcggagggaccgaagctgaccgccgtggtcgngcccaacgg

SEQ ID NO: 573014 - DNA, 491 bp, Homo sapiens
  misc_feature: HIJSMM301DN2Y6.10.20.B09.1.454.light.4.raw
catagtagtgcacgaccggtgctcgatttagtgtagtgtgaaggggggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgtcttcatt

SEQ ID NO: 573015 - DNA, 496 bp, Homo sapiens
  misc_feature: HIJSMM301BSLQ9.9.53.E09.1.454.light.4.raw
tgatacgtctcacgaccggtgctcgatttagagagagtgtgttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggccaaggtgaccgtcctaggtcagcccaaggctgccccctc

SEQ ID NO: 573016 - DNA, 486 bp, Homo sapiens; identical to SEQ ID NO: 543923
  misc_feature: HIJSMM301CH3AJ.3.88.H11.1.454.light.4.raw

SEQ ID NO: 573017 - DNA, 478 bp, Homo sapiens
  misc_feature: HIJSMM301BO0CJ.49.27.C05.1.454.light.4.raw
agtcgagagacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtggctgcacca

SEQ ID NO: 573018 - DNA, 447 bp, Homo sapiens; identical to SEQ ID NO: 535882
  misc_feature: HIJSMM301AYWS8.18.9.A09.1.454.light.4.raw
  modified_base (429)..(429): a, c, t, g, unknown or other

SEQ ID NO: 573019 - DNA, 495 bp, Homo sapiens
  misc_feature: HIJSMM301BVIMC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaaggcggaggatacagacgaactgtggctgcaccactctcgtcttcta

SEQ ID NO: 573020 - DNA, 483 bp, Homo sapiens
  misc_feature: HIJSMM301B70VQ.5.45.E01.1.454.light.4.raw
atcagacacgcacgaccggtgctcgatttagtgagtcagtaagggaaagggggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgctttcccgcgcacgtttggccaggggaccaaggtagagatcaaacgaactgtggctgcaccat

SEQ ID NO: 573021 - DNA, 447 bp, Homo sapiens; identical to SEQ ID NO: 535020
  misc_feature: HIJSMM301BRX74.18.9.A09.1.454.light.4.raw

SEQ ID NO: 573022 - DNA, 486 bp, Homo sapiens; identical to SEQ ID NO: 535385
  misc_feature: HIJSMM301C5UN2.19.71.G05.1.454.light.4.raw

SEQ ID NO: 573023 - DNA, 448 bp, Homo sapiens
  misc_feature: HIJSMM301D4BY5.18.9.A09.1.454.light.4.raw
  modified_base (430)..(430): a, c, t, g, unknown or other
tacgagtatgcacgaccggtgctcgatttagcgagacgcgcagggtcctgggcccagtctgtgctgacgcagccgccctcagtgtcctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccnccttcctccatactcgta

SEQ ID NO: 573024 - DNA, 487 bp, Homo sapiens; identical to SEQ ID NO: 538190
  misc_feature: HIJSMM301BTPE6.47.70.G04.1.454.light.4.raw

SEQ ID NO: 573025 - DNA, 489 bp, Homo sapiens; identical to SEQ ID NO: 535139
  misc_feature: HIJSMM301DJ17Q.14.55.E11.1.454.light.4.raw

SEQ ID NO: 573026 - DNA, 478 bp, Homo sapiens; identical to SEQ ID NO: 552745
  misc_feature: HIJSMM301E0ISZ.13.76.G10.1.454.light.4.raw

SEQ ID NO: 573027 - DNA, 383 bp, Homo sapiens; identical to SEQ ID NO: 447524
  misc_feature: HIJSMM301BM7LF.41.26.C04.1.454.light.4.raw

SEQ ID NO: 573028 - DNA, 486 bp, Homo sapiens; identical to SEQ ID NO: 536323
  misc_feature: HIJSMM301CV84T.10.2.A02.1.454.light.4.raw

SEQ ID NO: 573029 - DNA, 497 bp, Homo sapiens; identical to SEQ ID NO: 535286
  misc_feature: HIJSMM301EXZMD.18.59.F04.1.454.light.4.raw

SEQ ID NO: 573030 - DNA, 467 bp, Homo sapiens
  misc_feature: HIJSMM301B9OO0.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagattttcactctcaccatcagcagcctgcagcctgaagatgttgcaacttattactgtcaaaagaatagcgctgccccgctcagtttcggcggagggaccaaggtggagatacg

SEQ ID NO: 573031 - DNA, 490 bp, Homo sapiens; identical to SEQ ID NO: 535526
  misc_feature: HIJSMM301C6I0R.26.78.H01.1.454.light.4.raw

SEQ ID NO: 573032 - DNA, 491 bp, Homo sapiens; identical to SEQ ID NO: 535294
  misc_feature: HIJSMM301BYL7I.16.68.G02.1.454.light.4.raw

SEQ ID NO: 573033 - DNA, 487 bp, Homo sapiens; identical to SEQ ID NO: 537220
  misc_feature: HIJSMM301DPI3U.16.53.E09.1.454.light.4.raw

SEQ ID NO: 573034 - DNA, 447 bp, Homo sapiens; identical to SEQ ID NO: 535201
  misc_feature: HIJSMM301ARYKC.18.9.A09.1.454.light.4.raw

SEQ ID NO: 573035 - DNA, 518 bp, Homo sapiens
  misc_feature: HIJSMM301B84OJ.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacatattttaccctcaccatcaggggtctacagcctgaagattttgcgacttactattgtcaacagagttaccttctcccccggacgttcggtccaacggaccgaacggtacggaaagtacaacgacggaaactacgtggcgtgcgaccatctgtcttctactcttccgt

SEQ ID NO: 573036 - DNA, 492 bp, Homo sapiens
  misc_feature: HIJSMM301A5M1N.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccaggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgtattttgcaacttactactgtcatcagtacgttaccaaccctaacccctaactcctaccgtttccggtcccgtcgggtactagaagtgactatatagaagaagaacgt

SEQ ID NO: 573037 - DNA, 510 bp, Homo sapiens; identical to SEQ ID NO: 535474
  misc_feature: HIJSMM301AJ0QU.17.33.C11.1.454.light.4.raw

SEQ ID NO: 573038 - DNA, 510 bp, Homo sapiens
  misc_feature: HIJSMM301D8XR1.40.33.C11.1.454.light.4.raw
tctagcgactcacgaccggtgctcgatttagagtgagctcgttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagcccagaggatgagtcttattattactgcatgctccatgtggggggtgccacttgggtgttcggcggagggaccaagctgaccgtcctaggtcacgacccaaggctcgcccccgtcc

SEQ ID NO: 573039 - DNA, 479 bp, Homo sapiens
  misc_feature: HIJSMM301C5QIE.13.39.D06.1.454.light.4.raw
tcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaaggctgaccgtcct

SEQ ID NO: 573040 - DNA, 495 bp, Homo sapiens; identical to SEQ ID NO: 535486
  misc_feature: HIJSMM301C7SH3.26.72.G06.1.454.light.4.raw

SEQ ID NO: 573041 - DNA, 487 bp, Homo sapiens
  misc_feature: HIJSMM301BJASK.26.37.D04.1.454.light.4.raw
  modified_base (403)..(403): a, c, t, g, unknown or other
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcaggaccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttnttactgtcagcaatataatacctggcctccgctcactttcggcggagggaccaaggttgagatcaaacgaactgtggctgcacc

SEQ ID NO: 573042 - DNA, 508 bp, Homo sapiens; identical to SEQ ID NO: 550887
  misc_feature: HIJSMM301D8ITQ.4.57.F02.1.454.light.4.raw

SEQ ID NO: 573043 - DNA, 497 bp, Homo sapiens; identical to SEQ ID NO: 560060
  misc_feature: HIJSMM301AO937.22.86.H09.1.454.light.4.raw

SEQ ID NO: 573044 - DNA, 504 bp, Homo sapiens; identical to SEQ ID NO: 539690
  misc_feature: HIJSMM301DSS5O.47.65.F10.1.454.light.4.raw

SEQ ID NO: 573045 - DNA, 513 bp, Homo sapiens
  misc_feature: HIJSMM301DEFXZ.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagctcatatgcaggcagcaacagttttgcttcggaactgggacccaggtcaccgtcctaggtcagcccaaggccaaccccactgtcactctgttcccta

SEQ ID NO: 573046 - DNA, 495 bp, Homo sapiens
  misc_feature: HIJSMM301ADJ82.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgacttgggttttattcactttcggcccgtgggaccaaagtggatttcagacgaactgtggctgcaccatctgtcttcta

SEQ ID NO: 573047 - DNA, 464 bp, Homo sapiens; identical to SEQ ID NO: 562801
  misc_feature: HIJSMM301DSBGR.10.86.H09.1.454.light.4.raw

SEQ ID NO: 573048 - DNA, 495 bp, Homo sapiens
  misc_feature: HIJSMM301EHT6C.40.71.G05.1.454.light.4.raw
tctagcgactcacgaccggtgctcgatttagtgtcgtcgcaagagagagggggaagctctgcttcagctgtgagcgcagaaggcaggacttgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtcct

SEQ ID NO: 573049 - DNA, 505 bp, Homo sapiens
  misc_feature: HIJSMM301CFH2L.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggaggggaccaagctgaccgtcctacgtcagcccaaggctgccccctcggtcactctgttccccg

SEQ ID NO: 573050 - DNA, 457 bp, Homo sapiens
  misc_feature: HIJSMM301CP6BH.19.86.H09.1.454.light.4.raw
  modified_base (427)..(427): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctagaccgattctctggcgagaggtctggcgcctcagcttccctggccatcagagggctccagtctgaagatgaggctgattattactgtgcaatctgggatgacagtgtgaacggttccggtttcggcggagggaccaagctgaccgtcctaagtcagcgcaaggctcgccccctcggtcnctctcgttcccaccctcctccacgagagta

SEQ ID NO: 573051 - DNA, 494 bp, Homo sapiens
  misc_feature: HIJSMM301CXJSU.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaacgcccctgacctcctgatctatgctgcatccagtttgcacaggtggggtcccgtcaaggttcagtggcagtggatctgggacagatttcactctcaccgtcagcagtctgcaacctgaagtattttgcaacttactactgtcaacagagttacacgtacccccctcactttcggcggacgggaccaaggcggacatcagacgaactgtggctgcaccatctgtcttcta

SEQ ID NO: 573052 - DNA, 476 bp, Homo sapiens; identical to SEQ ID NO: 537812
  misc_feature: HIJSMM301B673P.3.82.H05.1.454.light.4.raw

SEQ ID NO: 573053 - DNA, 383 bp, Homo sapiens; identical to SEQ ID NO: 447524
  misc_feature: HIJSMM301CT8UY.41.26.C04.1.454.light.4.raw

SEQ ID NO: 573054 - DNA, 494 bp, Homo sapiens
  misc_feature: HIJSMM301BMA7B.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttatactgcatgcaagctctacaaactccttacacttttggccaggggaccaagctggagaatcaaaacgaactgtgg

SEQ ID NO: 573055 - DNA, 504 bp, Homo sapiens
  misc_feature: HIJSMM301D1FD4.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagactccctggcctgcagtggctccagtctgaggatgaggctgactattattgtgcagcgtgggatgacggtctgagtgctgtggtcttcggcggagggaccaagctgaccgtcctgggtcagcccaaggctgccccctcggtcact

SEQ ID NO: 573056 - DNA, 498 bp, Homo sapiens
  misc_feature: HIJSMM301C7AOW.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgcccctcggtcact

SEQ ID NO: 573057 - DNA, 514 bp, Homo sapiens
  misc_feature: HIJSMM301C0QC1.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtcccctctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 573058 - DNA, 480 bp, Homo sapiens
  misc_feature: HIJSMM301CGCGX.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccagggaccaggtggaaatcaaacgaactagtggctgcaccat

SEQ ID NO: 573059 - DNA, 486 bp, Homo sapiens
  misc_feature: HIJSMM301BWI49.49.68.G02.1.454.light.4.raw
agtcgagagacacgaccggtgctcgatttagtcgatagtgaagggaaagggggaggaactgctcagttaggacccagacggaaccatggaagccccagcgcagcttctcttcctcctgctactctggctcccagataccactggcaaaatagtgctgacgcagtctccagccaccctgtctcgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 573060 - DNA, 504 bp, Homo sapiens
  misc_feature: HIJSMM301C1ODO.14.3.A03.1.454.light.4.raw
cgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattaagcagaactgtggttttcggcggagggaccaaggtgaccgtcctaggtcagcccaaggctgcccctcggtcactctcg

SEQ ID NO: 573061 - DNA, 501 bp, Homo sapiens
  misc_feature: HIJSMM301EVDBE.40.23.C01.1.454.light.4.raw
tctagcgactcacgaccggtgctcgatttagtacacgtgattagggattgggggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcattcc

SEQ ID NO: 573062 - DNA, 465 bp, Homo sapiens
  misc_feature: HIJSMM301CXYZT.4.23.C01.1.454.light.4.raw
agcactgtagcacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcttctgtaggagacagagtcaccatcacttgccaggcgagtcaggacattaacaactatttaatttggtatcagcagaaaccaggccatgcccctaggctcctgatctacgatgcatcccatttggaaacaggggtcccatcaaggttcagtggaggtggatatgggacagattttactttcaccatcagcagcctgcagcctgaagatactgcaacatattactgtcaacagtatgataatctgccgctcactttcggcggagggaccaaggtggaggatcaagagaa

SEQ ID NO: 573063 - DNA, 446 bp, Homo sapiens
  misc_feature: HIJSMM301CYQSC.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccggggctgaggatgaggctgattattactgccaggcccttgacaacagtttgggtgtttgggtgttcggcggagggaccaagctgaccgtcctaagtcagcccaaggctgccccctcggtcactctcgttcccaccctcctccgtgtctgat

SEQ ID NO: 573064 - DNA, 494 bp, Homo sapiens; identical to SEQ ID NO: 557282
  misc_feature: HIJSMM301BJPTW.51.29.C07.1.454.light.4.raw

SEQ ID NO: 573065 - DNA, 484 bp, Homo sapiens
  misc_feature: HIJSMM301DMJ87.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgcccctcggtcactctgttcccacccctcctcctacgtaga

SEQ ID NO: 573066 - DNA, 500 bp, Homo sapiens
  misc_feature: HIJSMM301A2U1M.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccgaaggtggaaatacaaacgaactgtggctgcacc

SEQ ID NO: 573067 - DNA, 489 bp, Homo sapiens
  misc_feature: HIJSMM301ENPWE.22.87.H10.1.454.light.4.raw
acatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacagcccccaaactcctcatctatggtaacaacaatcggccctcaggggtccctgaccgattctctggctccaagtctggcatgtcagccctccctggccatcactgggcctccaggctgaggatgaggctgattatttctgccagtcctatgacaacagcctgggtgccgtggtattcggcggaggaccaagctgaccgtcta

SEQ ID NO: 573068 - DNA, 492 bp, Homo sapiens; identical to SEQ ID NO: 535126
  misc_feature: HIJSMM301BF3UU.18.11.A11.1.454.light.4.raw

SEQ ID NO: 573069 - DNA, 512 bp, Homo sapiens; identical to SEQ ID NO: 542831
  misc_feature: HIJSMM301CESSG.43.19.B08.1.454.light.4.raw

SEQ ID NO: 573070 - DNA, 488 bp, Homo sapiens; identical to SEQ ID NO: 538811
  misc_feature: HIJSMM301CA9SX.40.83.H06.1.454.light.4.raw

SEQ ID NO: 573071 - DNA, 504 bp, Homo sapiens
  misc_feature: HIJSMM301AKDWC.48.70.G04.1.454.light.4.raw
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtggaaatcaaacgaactgtggctgcaccatctgt

SEQ ID NO: 573072 - DNA, 505 bp, Homo sapiens
  misc_feature: HIJSMM301DC2RF.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctcggagcctgaagatgttgcagtttattactgtcaacatcgtaccgagtggcctccgggggccactttcggccctcggaccgaaagtggatatcaaacgaactgtggctgcaccatctgt

SEQ ID NO: 573073 - DNA, 517 bp, Homo sapiens; identical to SEQ ID NO: 539798
  misc_feature: HIJSMM301CGCIN.14.70.G04.1.454.light.4.raw

SEQ ID NO: 573074 - DNA, 503 bp, Homo sapiens; identical to SEQ ID NO: 538884
  misc_feature: HIJSMM301DN62K.27.78.H01.1.454.light.4.raw

SEQ ID NO: 573075 - DNA, 383 bp, Homo sapiens; identical to SEQ ID NO: 543660
  misc_feature: HIJSMM301CGPIV.41.37.D04.1.454.light.4.raw

SEQ ID NO: 573076 - DNA, 503 bp, Homo sapiens; identical to SEQ ID NO: 535044
  misc_feature: HIJSMM301EZE5Z.19.78.H01.1.454.light.4.raw

SEQ ID NO: 573077 - DNA, 463 bp, Homo sapiens; identical to SEQ ID NO: 535062
  misc_feature: HIJSMM301AXQC1.11.73.G07.1.454.light.4.raw

SEQ ID NO: 573078 - DNA, 495 bp, Homo sapiens
  misc_feature: HIJSMM301BY1YJ.40.37.D04.1.454.light.4.raw
tctagcgactcacgaccggtgctcgatttagtagcatactgttgggtttggggactgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagatcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggacttcggtccctcgggtaccgacgagaggagtgtcaaacgtaaacg

SEQ ID NO: 573079 - DNA, 507 bp, Homo sapiens; identical to SEQ ID NO: 535641
  misc_feature: HIJSMM301DJ56E.10.88.H11.1.454.light.4.raw

SEQ ID NO: 573080 - DNA, 496 bp, Homo sapiens
  misc_feature: HIJSMM301BBN6A.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcaca

SEQ ID NO: 573081 - DNA, 496 bp, Homo sapiens
  misc_feature: HIJSMM301AS4TT.21.27.C05.1.454.light.4.raw
  modified_base (198)..(198): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaagtcaaacgaactagtggctgcaccatctgtctt

SEQ ID NO: 573082 - DNA, 505 bp, Homo sapiens; identical to SEQ ID NO: 536254
  misc_feature: HIJSMM301EPKA2.7.71.G05.1.454.light.4.raw

SEQ ID NO: 573083 - DNA, 505 bp, Homo sapiens; identical to SEQ ID NO: 536117
  misc_feature: HIJSMM301BK4PG.8.71.G05.1.454.light.4.raw

SEQ ID NO: 573084 - DNA, 441 bp, Homo sapiens; identical to SEQ ID NO: 534971
  misc_feature: HIJSMM301B02YG.11.3.A03.1.454.light.4.raw

SEQ ID NO: 573085 - DNA, 501 bp, Homo sapiens
  misc_feature: HIJSMM301C3ROX.48.78.H01.1.454.light.4.raw
agtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccctc

SEQ ID NO: 573086 - DNA, 495 bp, Homo sapiens
  misc_feature: HIJSMM301D1DLT.48.63.F08.1.454.light.4.raw
agtatacatacacgaccggtgctcgatttagcgatcgtataaggggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggccagggactaagctggagatcaaacgaactgtggctgcaccatctgtcttcatcttccccg

SEQ ID NO: 573087 - DNA, 484 bp, Homo sapiens; identical to SEQ ID NO: 535400
  misc_feature: HIJSMM301CPEZC.46.26.C04.1.454.light.4.raw

SEQ ID NO: 573088 - DNA, 520 bp, Homo sapiens; identical to SEQ ID NO: 539176
  misc_feature: HIJSMM301A9N2J.27.23.C01.1.454.light.4.raw

SEQ ID NO: 573089 - DNA, 491 bp, Homo sapiens
  misc_feature: HIJSMM301AMVN7.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaactggtgtcccatcaaggttcagcggcagtggatctgggacagaattcactctcgccatcagcagcctgcagcctgatgattctgcaacttattactgccaacagtattatagttatcgggggacgttcgaccaagggaccaaggtggaaatcaaacgaactgtggctgcaccatctgt

SEQ ID NO: 573090 - DNA, 501 bp, Homo sapiens
  misc_feature: HIJSMM301BVT6W.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatacaaacgaactgtggctgcaccatctgtctt

SEQ ID NO: 573091 - DNA, 504 bp, Homo sapiens
  misc_feature: HIJSMM301AVE4L.5.24.C02.1.454.light.4.raw
  modified_base (494)..(494): a, c, t, g, unknown or other
atcagacacgcacgaccggtgctcgatttagtacagatcgttagggaaagggcacgaccggtgctcgatttagtacagatcgttagggaaagggggggtcgtcaggaggcagcgctctcaggacgtcaccaccatggcctggctctgctcctcctcaccctcctcactcagggcacagggtcctcgggcccacggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtnatcttcggcc

SEQ ID NO: 573092 - DNA, 495 bp, Homo sapiens
  misc_feature: HIJSMM301B3PN6.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagcgtaggagataacaaacgaactgtggctcgcaccta

SEQ ID NO: 573093 - DNA, 516 bp, Homo sapiens
  misc_feature: HIJSMM301APYX4.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtaggaaagtacaagacgaactagtggcgtgcgaccactctgtcttctactcttcccgt

SEQ ID NO: 573094 - DNA, 518 bp, Homo sapiens
  misc_feature: HIJSMM301CG6SO.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggaggaccaagttgaccgtcctaagtcagcccaaggctgccccctcggtcactctgttcccccg

SEQ ID NO: 573095 - DNA, 483 bp, Homo sapiens
  misc_feature: HIJSMM301CYCFK.11.17.B06.1.454.light.4.raw
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgctaacttactactgtcaacagagttacagtaccccgtggacgttcggccaagggaccaaggtggaaatcaaacgaactagtggctgcaccta

SEQ ID NO: 573096 - DNA, 486 bp, Homo sapiens; identical to SEQ ID NO: 535385
  misc_feature: HIJSMM301EVYAX.19.71.G05.1.454.light.4.raw

SEQ ID NO: 573097 - DNA, 490 bp, Homo sapiens; identical to SEQ ID NO: 550493
  misc_feature: HIJSMM301EMOAA.10.59.F04.1.454.light.4.raw

SEQ ID NO: 573098 - DNA, 491 bp, Homo sapiens; identical to SEQ ID NO: 535194
  misc_feature: HIJSMM301DNQLZ.26.78.H01.1.454.light.4.raw

SEQ ID NO: 573099 - DNA, 479 bp, Homo sapiens
  misc_feature: HIJSMM301C5518.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctcgccccctcggtcactctgttcccaccctcctcgagtagtaca

SEQ ID NO: 573100 - DNA, 485 bp, Homo sapiens
  misc_feature: HIJSMM301AST1F.49.35.D02.1.454.light.4.raw
agtcgagagacacgaccggtgctcgatttagcacacgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaaacg

SEQ ID NO: 573101 - DNA, 487 bp, Homo sapiens; identical to SEQ ID NO: 536206
  misc_feature: HIJSMM301CU1XO.47.38.D05.1.454.light.4.raw

SEQ ID NO: 573102 - DNA, 494 bp, Homo sapiens; identical to SEQ ID NO: 553476
  misc_feature: HIJSMM301EGUQN.16.53.E09.1.454.light.4.raw

SEQ ID NO: 573103 - DNA, 509 bp, Homo sapiens
  misc_feature: HIJSMM301B1WFH.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcaggtgggccaagtggaggatgaagctgactactactgttactcaatagagaacagtgataatttctgggttgttcggcggagggaccaaacgtgaccgttcctaggtcagcccaaggctcgccccctcggtcactctcgtt

SEQ ID NO: 573104 - DNA, 489 bp, Homo sapiens; identical to SEQ ID NO: 549642
  misc_feature: HIJSMM301BA0DY.52.70.G04.1.454.light.4.raw

SEQ ID NO: 573105 - DNA, 492 bp, Homo sapiens
  misc_feature: HIJSMM301AJWMO.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagttattccttttactttcggccctgggaccaaagtggatatcaaacaaactgtggctgcaccat

SEQ ID NO: 573106 - DNA, 511 bp, Homo sapiens
  misc_feature: HIJSMM301ELTSV.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctggggccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccatgtcactctgttcccacccct

SEQ ID NO: 573107 - DNA, 489 bp, Homo sapiens; identical to SEQ ID NO: 543840
  misc_feature: HIJSMM301ADK88.12.88.H11.1.454.light.4.raw

SEQ ID NO: 573108 - DNA, 517 bp, Homo sapiens
  misc_feature: HIJSMM301CXS34.51.86.H09.1.454.light.4.raw
cgatcgtatacacgaccggtgctcgatttagtgctatagacttgggtttgggggatcaggactcctcagttcaccttctcacaatgaggctccctgctcagctcctggggctgctaatgctctgggtcccaggttccagtggggatattgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggtccaagggaccgaaggtaggaaagtacaaacgaaactgtggcgtgcaccatctgtcttctatt

SEQ ID NO: 573109 - DNA, 509 bp, Homo sapiens; identical to SEQ ID NO: 539359
  misc_feature: HIJSMM301DJ39X.47.85.H08.1.454.light.4.raw

SEQ ID NO: 573110 - DNA, 486 bp, Homo sapiens
  misc_feature: HIJSMM301BJLDQ.4.33.C11.1.454.light.4.raw
agcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatacaacgaa

SEQ ID NO: 573111 - DNA, 478 bp, Homo sapiens
  misc_feature: HIJSMM301BFYW4.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagaccccg

SEQ ID NO: 573112 - DNA, 487 bp, Homo sapiens; identical to SEQ ID NO: 537208
  misc_feature: HIJSMM301CT29Y.3.55.E11.1.454.light.4.raw

SEQ ID NO: 573113 - DNA, 473 bp, Homo sapiens; identical to SEQ ID NO: 535262
  misc_feature: HIJSMM301DRRI9.8.67.G01.1.454.light.4.raw

SEQ ID NO: 573114 - DNA, 493 bp, Homo sapiens; identical to SEQ ID NO: 544335
  misc_feature: HIJSMM301ECV4O.5.57.F02.1.454.light.4.raw

SEQ ID NO: 573115 - DNA, 499 bp, Homo sapiens; identical to SEQ ID NO: 548304
  misc_feature: HIJSMM301AJGQK.48.41.D08.1.454.light.4.raw

SEQ ID NO: 573116 - DNA, 506 bp, Homo sapiens
  misc_feature: HIJSMM301DJRQH.47.55.E11.1.454.light.4.raw
agctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaaccggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggcccaa

SEQ ID NO: 573117 - DNA, 509 bp, Homo sapiens
  misc_feature: HIJSMM301AHU8T.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgtcc

SEQ ID NO: 573118 - DNA, 514 bp, Homo sapiens; identical to SEQ ID NO: 541418
  misc_feature: HIJSMM301ADAXS.17.33.C11.1.454.light.4.raw

SEQ ID NO: 573119 - DNA, 497 bp, Homo sapiens; identical to SEQ ID NO: 535286
  misc_feature: HIJSMM301AH4JP.18.59.F04.1.454.light.4.raw

SEQ ID NO: 573120 - DNA, 447 bp, Homo sapiens; identical to SEQ ID NO: 535201
  misc_feature: HIJSMM301DYLRJ.18.9.A09.1.454.light.4.raw

SEQ ID NO: 573121 - DNA, 503 bp, Homo sapiens
  misc_feature: HIJSMM301A2QQG.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctggacaccagcctcgctgcttggcttttcggcggaggaccaagctgaccgtcctggtcagcccaaggctcgccccctcggtcta

SEQ ID NO: 573122 - DNA, 479 bp, Homo sapiens
  misc_feature: HIJSMM301CMZXO.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagatttgcaacttattactgtcaacaggtttatatttaccctcgtattttcggcccttgggaccacagtagatatcaaacgaactgtggctgcacc

SEQ ID NO: 573123 - DNA, 488 bp, Homo sapiens; identical to SEQ ID NO: 535081
  misc_feature: HIJSMM301BQKYK.26.23.C01.1.454.light.4.raw

SEQ ID NO: 573124 - DNA, 494 bp, Homo sapiens
  misc_feature: HIJSMM301A75BT.4.27.C05.1.454.light.4.raw
  modified_base (409)..(409): a, c, t, g, unknown or other
agcactgtagcacgaccggtgctcgatttagacgcgatcgaagggtttggggctgggcctcaggaagcagcatcggaggtgcctcagccatgacatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcncacgtgggacatgggcactgcgatcttcggcggagggaccaagctgaccgtcctgggtcagcccaaggctgccccctcggtcact

SEQ ID NO: 573125 - DNA, 506 bp, Homo sapiens
  misc_feature: HIJSMM301BRLY1.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctggatcgcttctctggctccaagtctggcaacacggcctccctgaccatctctgggctccaggctgaagatcaggctgattattactgctgttcattttcaagttcctttttgtctttcggaactgggaccgaggtcaccgtcctaggtcagcccaaggccaaccccactgtcta

SEQ ID NO: 573126 - DNA, 493 bp, Homo sapiens; identical to SEQ ID NO: 535084
  misc_feature: HIJSMM301DS3OE.47.64.F09.1.454.light.4.raw

SEQ ID NO: 573127 - DNA, 498 bp, Homo sapiens; identical to SEQ ID NO: 541355
  misc_feature: HIJSMM301BPYNH.12.87.H10.1.454.light.4.raw

SEQ ID NO: 573128 - DNA, 466 bp, Homo sapiens; identical to SEQ ID NO: 536398
  misc_feature: HIJSMM301CWLKN.3.20.B09.1.454.light.4.raw

SEQ ID NO: 573129 - DNA, 516 bp, Homo sapiens
  misc_feature: HIJSMM301A1MNK.41.25.C03.1.454.light.4.raw
tctatactatcacgaccggtgctcgatttagtagtgtagatttgggtttgggggtgatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgtt

SEQ ID NO: 573130 - DNA, 492 bp, Homo sapiens
  misc_feature: HIJSMM301BW34D.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtgggcccatcaaggttcagtggcagtggctctgggacagatttcactctcaccatcagcagtctccaacctgaagattttgcaacttactactgtcaacagagtttcagtagtccccggacgttcggccagggaccgaaggtggacgatcaaacgaaactagtggctgcaccatctgtctt

SEQ ID NO: 573131 - DNA, 491 bp, Homo sapiens; identical to SEQ ID NO: 536211
  misc_feature: HIJSMM301EJZAQ.16.53.E09.1.454.light.4.raw

SEQ ID NO: 573132 - DNA, 454 bp, Homo sapiens
  misc_feature: HIJSMM301EULAS.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccgccctcctccaccgagagta

SEQ ID NO: 573133 - DNA, 513 bp, Homo sapiens
  misc_feature: HIJSMM301A58WU.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagagtggtgccttctttctaagggttttcggcgggagggaccaggctgaccgtcctaagtcacgcccaaggctcgccccctcggt

SEQ ID NO: 573134 - DNA, 509 bp, Homo sapiens
  misc_feature: HIJSMM301DHYYG.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggtttttggcggagggactaagctgaccgtcctaagtcagcccaaggctcgccccctcggtcactctcgttcccta

SEQ ID NO: 573135 - DNA, 506 bp, Homo sapiens
  misc_feature: HIJSMM301DQGZL.11.67.G01.1.454.light.4.raw
cgagagataccacgaccggtgctcgatttagagtatacatattgggtttggggggttggagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctggggtcagcccaaggctgccccctcggtcactt

SEQ ID NO: 573136 - DNA, 479 bp, Homo sapiens; identical to SEQ ID NO: 535118
  misc_feature: HIJSMM301DOHDH.13.59.F04.1.454.light.4.raw

SEQ ID NO: 573137 - DNA, 511 bp, Homo sapiens
  misc_feature: HIJSMM301A1YTB.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgtccccccg

SEQ ID NO: 573138 - DNA, 484 bp, Homo sapiens; identical to SEQ ID NO: 550726
  misc_feature: HIJSMM301DGKFY.47.62.F07.1.454.light.4.raw

SEQ ID NO: 573139 - DNA, 500 bp, Homo sapiens
  misc_feature: HIJSMM301D31QZ.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacatctgagcggttgggtgttcggcggaggaccaaactgaccgtcctaggtcagcccaa

SEQ ID NO: 573140 - DNA, 495 bp, Homo sapiens; identical to SEQ ID NO: 572414
  misc_feature: HIJSMM301CZ3WD.12.38.D05.1.454.light.4.raw

SEQ ID NO: 573141 - DNA, 511 bp, Homo sapiens
  misc_feature: HIJSMM301E0J4O.43.67.G01.1.454.light.4.raw
tgtgagtagtcacgaccggtgctcgatttagagtatacatattgggtttgggggagctacaacaggcaggcaggggcagcagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtacggaagtacaaacgaaactgtggctgcaccatctgtctt

SEQ ID NO: 573142 - DNA, 479 bp, Homo sapiens; identical to SEQ ID NO: 535118
  misc_feature: HIJSMM301D3XAA.13.59.F04.1.454.light.4.raw

SEQ ID NO: 573143 - DNA, 416 bp, Homo sapiens; identical to SEQ ID NO: 535308
  misc_feature: HIJSMM301DP836.16.46.E02.1.454.light.4.raw

SEQ ID NO: 573144 - DNA, 498 bp, Homo sapiens; identical to SEQ ID NO: 570461
  misc_feature: HIJSMM301DSMAZ.10.79.H02.1.454.light.4.raw

SEQ ID NO: 573145 - DNA, 483 bp, Homo sapiens; identical to SEQ ID NO: 555750
  misc_feature: HIJSMM301EL538.41.78.H01.1.454.light.4.raw

SEQ ID NO: 573146 - DNA, 502 bp, Homo sapiens
  misc_feature: HIJSMM301CH6FT.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagttcatatgcaggcatcaacactgttttcggtcgggagggaccaagctgaccgtcctaggtcagcccaaggctcgccccctccggtcactctcgttcccaccctcctcgacgtgcgtct

SEQ ID NO: 573147 - DNA, 511 bp, Homo sapiens
  misc_feature: HIJSMM301CC08F.49.27.C05.1.454.light.4.raw
agtcgagagacacgaccggtgctcgatttagacgcgatcgaagggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggcgtcgggaccaggctgaccgtcctgggtcagcccaaggctgccccctcggtcactctgttcccgcctt

SEQ ID NO: 573148 - DNA, 492 bp, Homo sapiens
  misc_feature: HIJSMM301ALNKA.51.57.F02.1.454.light.4.raw
cgatcgtatacacgaccggtgctcgatttagctcgatatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccact

SEQ ID NO: 573149 - DNA, 511 bp, Homo sapiens
  misc_feature: HIJSMM301EQGOC.52.87.H10.1.454.light.4.raw
cgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattacctgtgggggatacaacattggaactaaaaatgtgcagtggtaccagcagaagccaggccaggcccctgtgttggtcatctatagggatcgaagacgggcctctgggattcctgagcgattctctggctccaactcggagaacacggccaccctgacccatcagaagtgcccaagtcggtgatgaggcagactattactgccaggtgtgggacagtggtgttgtgatattcggcggagggaccaagctgaccgtcctaagtcagcccaaggctgccccctcggtcactctgttcccacctcct

SEQ ID NO: 573150 - DNA, 512 bp, Homo sapiens
  misc_feature: HIJSMM301EGLZ0.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttaccgtcccgtgacgttcgcaaggacaagtggcaatcaacgaactgtggctgcaccatctgtcttctatcttccccg

SEQ ID NO: 573151 - DNA, 495 bp, Homo sapiens; identical to SEQ ID NO: 535821
  misc_feature: HIJSMM301EH4M7.3.31.C09.1.454.light.4.raw

SEQ ID NO: 573152 - DNA, 486 bp, Homo sapiens; identical to SEQ ID NO: 535290
  misc_feature: HIJSMM301DXHZN.3.12.B01.1.454.light.4.raw

SEQ ID NO: 573153 - DNA, 503 bp, Homo sapiens; identical to SEQ ID NO: 545754
  misc_feature: HIJSMM301CV5FW.19.78.H01.1.454.light.4.raw

SEQ ID NO: 573154 - DNA, 484 bp, Homo sapiens; identical to SEQ ID NO: 535400
  misc_feature: HIJSMM301EEJR2.46.26.C04.1.454.light.4.raw

SEQ ID NO: 573155 - DNA, 509 bp, Homo sapiens; identical to SEQ ID NO: 539359
  misc_feature: HIJSMM301BX6SJ.47.85.H08.1.454.light.4.raw

SEQ ID NO: 573156 - DNA, 485 bp, Homo sapiens
  misc_feature: HIJSMM301AXHR1.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaacggtgggaaatacaaacgaactacgtggctgcacca

SEQ ID NO: 573157 - DNA, 520 bp, Homo sapiens
  misc_feature: HIJSMM301BBL00.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggaccgaacggtaggaagtacgaaacgaactacgtggtcgtgcaccactctcgtcttctatcttcccgtccctact

SEQ ID NO: 573158 - DNA, 490 bp, Homo sapiens
  misc_feature: HIJSMM301ANEN0.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcggtctattactgtcagcagtatggtcacgtcccaagaacttttggccaggggaccaagctggagatcaaacgaactgtggctgcaccatctgt

SEQ ID NO: 573159 - DNA, 441 bp, Homo sapiens; identical to SEQ ID NO: 551059
  misc_feature: HIJSMM301A77G6.11.3.A03.1.454.light.4.raw
  modified_base (423)..(423): a, c, t, g, unknown or other

SEQ ID NO: 573160 - DNA, 507 bp, Homo sapiens; identical to SEQ ID NO: 541461
  misc_feature: HIJSMM301DC226.11.57.F02.1.454.light.4.raw

SEQ ID NO: 573161 - DNA, 518 bp, Homo sapiens; identical to SEQ ID NO: 543797
  misc_feature: HIJSMM301AOA58.19.80.H03.1.454.light.4.raw

SEQ ID NO: 573162 - DNA, 504 bp, Homo sapiens; identical to SEQ ID NO: 534983
  misc_feature: HIJSMM301CDWQ0.9.12.B01.1.454.light.4.raw

SEQ ID NO: 573163 - DNA, 441 bp, Homo sapiens; identical to SEQ ID NO: 534971
  misc_feature: HIJSMM301EM410.11.3.A03.1.454.light.4.raw

SEQ ID NO: 573164 - DNA, 503 bp, Homo sapiens
  misc_feature: HIJSMM301ESEVD.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccta

SEQ ID NO: 573165 - DNA, 478 bp, Homo sapiens; identical to SEQ ID NO: 573111
  misc_feature: HIJSMM301CNKNQ.13.76.G10.1.454.light.4.raw

SEQ ID NO: 573166 - DNA, 503 bp, Homo sapiens; identical to SEQ ID NO: 555891
  misc_feature: HIJSMM301DZL8N.9.12.B01.1.454.light.4.raw

SEQ ID NO: 573167 - DNA, 485 bp, Homo sapiens
  misc_feature: HIJSMM301AQQH8.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaaagtggatatcaaacgaaactgtggctgcaccatctgt

SEQ ID NO: 573168 - DNA, 494 bp, Homo sapiens
  misc_feature: HIJSMM301B1RJ2.9.22.B11.1.454.light.4.raw
tgatacgtctcacgaccggtgctcgatttagacgacagctcaggggagctctgcttcagctgtgagcgcagaaggcaggactcgggacaatcttcatcatgacctgctcccctctcctcctcacccttctcattcactgcacagggtcctgggcccagtctgtggtgacgcagccgccctcagtgtctgcggccccaggacagagggtcaccatctcctgctctggaaacctcaccaacattgagagcaattatgtttcctggtaccagcagctcccaggaagagcccccaaactcctcatctatgacaatgataaacgaccctcagggattcctgaccgtttctctgcctccaagtctggctcgtcagccaccctggccatcaccggactccagactggggacgaggcccattattactgcggaacatgggattacaggttgagtgttggggctttcggcggagggaccgagctgagcgtcctaggtcagccc

SEQ ID NO: 573169 - DNA, 506 bp, Homo sapiens
  misc_feature: HIJSMM301BV31L.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactc

SEQ ID NO: 573170 - DNA, 509 bp, Homo sapiens; identical to SEQ ID NO: 553073
  misc_feature: HIJSMM301AZWMQ.16.1.A01.1.454.light.4.raw

SEQ ID NO: 573171 - DNA, 486 bp, Homo sapiens; identical to SEQ ID NO: 535054
  misc_feature: HIJSMM301BY71S.47.70.G04.1.454.light.4.raw

SEQ ID NO: 573172 - DNA, 510 bp, Homo sapiens
  misc_feature: HIJSMM301CIWYK.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtctccggaactgggaccaaggtcaccgtcctaggtcagcccaaggccaacccactgtcactcttcg

SEQ ID NO: 573173 - DNA, 517 bp, Homo sapiens
  misc_feature: HIJSMM301CZ6BY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgtcgacggaccgaacggtaggaagtacgaaacgaaactagtaggcgtcgcgaccaactctcgtcttctactctttccccg

SEQ ID NO: 573174 - DNA, 513 bp, Homo sapiens; identical to SEQ ID NO: 535244
  misc_feature: HIJSMM301AUVBB.17.33.C11.1.454.light.4.raw

SEQ ID NO: 573175 - DNA, 486 bp, Homo sapiens; identical to SEQ ID NO: 535385
  misc_feature: HIJSMM301DERQW.19.71.G05.1.454.light.4.raw

SEQ ID NO: 573176 - DNA, 506 bp, Homo sapiens; identical to SEQ ID NO: 534969
  misc_feature: HIJSMM301B7Q6F.18.37.D04.1.454.light.4.raw

SEQ ID NO: 573177 - DNA, 492 bp, Homo sapiens
  misc_feature: HIJSMM301C29M2.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgagatgtggcagtttattactgtcagcaatatttcgtgctccgtactacttttggccagggacccaggtggagatcagacgaactgtggctgcaccatctgtcttcatcttccg

SEQ ID NO: 573178 - DNA, 494 bp, Homo sapiens; identical to SEQ ID NO: 534992
  misc_feature: HIJSMM301CB0FI.9.1.A01.1.454.light.4.raw

SEQ ID NO: 573179 - DNA, 507 bp, Homo sapiens
  misc_feature: HIJSMM301C1YXZ.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctcttttcaaggttttcggcggagggaccaggctgaccgtcctaagtcagcccaaggctgccccctcggt

SEQ ID NO: 573180 - DNA, 477 bp, Homo sapiens
  misc_feature: HIJSMM301C7ML3.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagactgttatcagcagctccttagcctggtaccagcagaaacctggccaggctcccaggctcctcatctatggtgcatccagcagggccgctggcatcccagacaggtttagtggcagtgggtctgggacagacttcactctcaccatcagcagactggagcctgaagattttgcagtgtatttctgtcagcagtatggtggctcacccgcgtacagttttggccaggggaccaagctggagatcaagcgaa

SEQ ID NO: 573181 - DNA, 501 bp, Homo sapiens
  misc_feature: HIJSMM301DW3TP.48.71.G05.1.454.light.4.raw
agtatacatacacgaccggtgctcgatttagtgtcgtcgcaagagagaggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttcccg

SEQ ID NO: 573182 - DNA, 506 bp, Homo sapiens; identical to SEQ ID NO: 539705
  misc_feature: HIJSMM301EF9JN.40.67.G01.1.454.light.4.raw

SEQ ID NO: 573183 - DNA, 481 bp, Homo sapiens
  misc_feature: HIJSMM301D2RZZ.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggaggaccaaggtggagatcaaacgaactgtggctgca

SEQ ID NO: 573184 - DNA, 518 bp, Homo sapiens
  misc_feature: HIJSMM301AQZXO.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccgccctcctc

SEQ ID NO: 573185 - DNA, 478 bp, Homo sapiens
  misc_feature: HIJSMM301D16BK.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccc

SEQ ID NO: 573186 - DNA, 508 bp, Homo sapiens; identical to SEQ ID NO: 540640
  misc_feature: HIJSMM301EJZHB.5.60.F05.1.454.light.4.raw

SEQ ID NO: 573187 - DNA, 519 bp, Homo sapiens; identical to SEQ ID NO: 547780
  misc_feature: HIJSMM301AKRNY.5.27.C05.1.454.light.4.raw

SEQ ID NO: 573188 - DNA, 485 bp, Homo sapiens; identical to SEQ ID NO: 539536
  misc_feature: HIJSMM301BDULB.48.38.D05.1.454.light.4.raw

SEQ ID NO: 573189 - DNA, 494 bp, Homo sapiens; identical to SEQ ID NO: 534994
  misc_feature: HIJSMM301CH0TV.27.78.H01.1.454.light.4.raw

SEQ ID NO: 573190 - DNA, 505 bp, Homo sapiens
  misc_feature: HIJSMM301B0OH2.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccggggaccaacgtggaaatcaaacgaactgtggctgcaccatctgtcttcat

SEQ ID NO: 573191 - DNA, 505 bp, Homo sapiens; identical to SEQ ID NO: 550885
  misc_feature: HIJSMM301B8N0U.18.78.H01.1.454.light.4.raw

SEQ ID NO: 573192 - DNA, 516 bp, Homo sapiens
  misc_feature: HIJSMM301B58FL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgtccgaacgggaccgaacggtaggaaagtactaaacgaactagtggcgtgcaccactctcgtcttctactcttccccg

SEQ ID NO: 573193 - DNA, 488 bp, Homo sapiens; identical to SEQ ID NO: 537260
  misc_feature: HIJSMM301D33ZI.47.70.G04.1.454.light.4.raw

SEQ ID NO: 573194 - DNA, 511 bp, Homo sapiens; identical to SEQ ID NO: 548439
  misc_feature: HIJSMM301A3JWM.16.46.E02.1.454.light.4.raw

SEQ ID NO: 573195 - DNA, 447 bp, Homo sapiens; identical to SEQ ID NO: 535201
  misc_feature: HIJSMM301CMHH9.18.9.A09.1.454.light.4.raw

SEQ ID NO: 573196 - DNA, 515 bp, Homo sapiens; identical to SEQ ID NO: 536247
  misc_feature: HIJSMM301EEZGY.14.19.B08.1.454.light.4.raw

SEQ ID NO: 573197 - DNA, 501 bp, Homo sapiens
  misc_feature: HIJSMM301CV739.48.73.G07.1.454.light.4.raw
agtatacatacacgaccggtgctcgatttagctctacgctcagggcacgaccggtgctcgatttagatcgtctgtgttgggtttggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggcccaagggacacgactggagattaaccgaactgtggctgcacc

SEQ ID NO: 573198 - DNA, 489 bp, Homo sapiens
  misc_feature: HIJSMM301EQQQJ.48.73.G07.1.454.light.4.raw
agtatacatacacgaccggtgctcgatttagctctacgctcagggcacgaccggtgctcgatttagctctacgctcagggcacgaccggtgctcgatttagagtgctacgaagggaaaggggctgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctcggggtccctgacaggttcagtggcagtggatcaggcacagattttacactgaaaatcagcagagtggaggctgaggatgttggggtttattac

SEQ ID NO: 573199 - DNA, 502 bp, Homo sapiens; identical to SEQ ID NO: 538158
  misc_feature: HIJSMM301AWVB7.5.86.H09.1.454.light.4.raw

SEQ ID NO: 573200 - DNA, 492 bp, Homo sapiens
  misc_feature: HIJSMM301D2OBW.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtctaggtcagcccaaggccaaccccactgtcactctcg

SEQ ID NO: 573201 - DNA, 503 bp, Homo sapiens; identical to SEQ ID NO: 544567
  misc_feature: HIJSMM301DNM4W.41.35.D02.1.454.light.4.raw

SEQ ID NO: 573202 - DNA, 494 bp, Homo sapiens; identical to SEQ ID NO: 535629
  misc_feature: HIJSMM301A7ILQ.4.27.C05.1.454.light.4.raw

SEQ ID NO: 573203 - DNA, 493 bp, Homo sapiens; identical to SEQ ID NO: 535047
  misc_feature: HIJSMM301BYM1W.16.53.E09.1.454.light.4.raw

SEQ ID NO: 573204 - DNA, 488 bp, Homo sapiens; identical to SEQ ID NO: 541868
  misc_feature: HIJSMM301A5S31.14.55.E11.1.454.light.4.raw

SEQ ID NO: 573205 - DNA, 484 bp, Homo sapiens; identical to SEQ ID NO: 557851
  misc_feature: HIJSMM301DACR8.46.26.C04.1.454.light.4.raw
  modified_base (459)..(459): a, c, t, g, unknown or other

SEQ ID NO: 573206 - DNA, 444 bp, Homo sapiens; identical to SEQ ID NO: 535856
  misc_feature: HIJSMM301COGCC.9.9.A09.1.454.light.4.raw

SEQ ID NO: 573207 - DNA, 520 bp, Homo sapiens
  misc_feature: HIJSMM301A5K36.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggttcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttcccgcct

SEQ ID NO: 573208 - DNA, 484 bp, Homo sapiens; identical to SEQ ID NO: 535400
  misc_feature: HIJSMM301C0OFL.46.26.C04.1.454.light.4.raw

SEQ ID NO: 573209 - DNA, 493 bp, Homo sapiens
  misc_feature: HIJSMM301D3WM0.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccgggctgaggacgaggctgattattactgcagctcatatacaagcagcagcactctcgtggtattcggcggagggaccaagctgaccgtcctaggtcagcccaaggctg

SEQ ID NO: 573210 - DNA, 501 bp, Homo sapiens; identical to SEQ ID NO: 562122
  misc_feature: HIJSMM301CGU37.9.81.H04.1.454.light.4.raw

SEQ ID NO: 573211 - DNA, 497 bp, Homo sapiens; identical to SEQ ID NO: 535664
  misc_feature: HIJSMM301A8ROK.22.14.B03.1.454.light.4.raw

SEQ ID NO: 573212 - DNA, 493 bp, Homo sapiens; identical to SEQ ID NO: 535745
  misc_feature: HIJSMM301AK2H1.47.78.H01.1.454.light.4.raw

SEQ ID NO: 573213 - DNA, 503 bp, Homo sapiens; identical to SEQ ID NO: 540665
  misc_feature: HIJSMM301DGVT5.4.57.F02.1.454.light.4.raw

SEQ ID NO: 573214 - DNA, 506 bp, Homo sapiens; identical to SEQ ID NO: 558201
  misc_feature: HIJSMM301ERZHV.47.83.H06.1.454.light.4.raw

SEQ ID NO: 573215 - DNA, 485 bp, Homo sapiens; identical to SEQ ID NO: 556702
  misc_feature: HIJSMM301CO0GV.49.3.A03.1.454.light.4.raw

SEQ ID NO: 573216 - DNA, 485 bp, Homo sapiens
  misc_feature: HIJSMM301DULG7.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcaagaaacctgggcaggctcccaggctcctcatctttgatgcgtccaccagggccactggtttcccagccaggttcagtggcagtgcgtctgcgacagagttcactctcaccatcaacagcctgcagtctgaagtattttgcagtttattactgtcagcagtatcatgactggccgctcaccttcggccaagggacacgactggagattaaacgaactgtggctgcacat

SEQ ID NO: 573217 - DNA, 482 bp, Homo sapiens
  misc_feature: HIJSMM301ALTZO.48.19.B08.1.454.light.4.raw
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgacccgtcctaggtcacg

SEQ ID NO: 573218 - DNA, 499 bp, Homo sapiens; identical to SEQ ID NO: 551068
  misc_feature: HIJSMM301C6FIJ.19.78.H01.1.454.light.4.raw

SEQ ID NO: 573219 - DNA, 489 bp, Homo sapiens; identical to SEQ ID NO: 544329
  misc_feature: HIJSMM301EDXQO.11.28.C06.1.454.light.4.raw

SEQ ID NO: 573220 - DNA, 502 bp, Homo sapiens
  misc_feature: HIJSMM301B5TCX.48.53.E09.1.454.light.4.raw
agtatacatacacgaccggtgctcgatttagagagagtgtgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaataatagtcaatcgaactgtggctgcaccatctgtcttcatt

SEQ ID NO: 573221 - DNA, 507 bp, Homo sapiens; identical to SEQ ID NO: 536269
  misc_feature: HIJSMM301CI2G6.4.57.F02.1.454.light.4.raw

SEQ ID NO: 573222 - DNA, 510 bp, Homo sapiens; identical to SEQ ID NO: 538614
  misc_feature: HIJSMM301AJZQI.19.59.F04.1.454.light.4.raw

SEQ ID NO: 573223 - DNA, 493 bp, Homo sapiens; identical to SEQ ID NO: 535084
  misc_feature: HIJSMM301ALSSY.47.64.F09.1.454.light.4.raw

SEQ ID NO: 573224 - DNA, 508 bp, Homo sapiens
  misc_feature: HIJSMM301CKAJ9.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatggaggccgactattactgtcaggtgtgggatagtagtggtgatcatccatacgtcttcggaactgggaccaaggtctccgtcctacgtcagcccaaggccaacccactgtcactctcg

SEQ ID NO: 573225 - DNA, 501 bp, Homo sapiens; identical to SEQ ID NO: 536142
  misc_feature: HIJSMM301DCG7A.15.1.A01.1.454.light.4.raw

SEQ ID NO: 573226 - DNA, 497 bp, Homo sapiens
  misc_feature: HIJSMM301D2T09.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccgctcactttcggcggagggaccaaggtggagatcaaacgaactgtggctgcaccatctgtcttcat

SEQ ID NO: 573227 - DNA, 493 bp, Homo sapiens
  misc_feature: HIJSMM301EKXBO.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtctttatcttcccg

SEQ ID NO: 573228 - DNA, 445 bp, Homo sapiens; identical to SEQ ID NO: 537719
  misc_feature: HIJSMM301DUB1T.47.85.H08.1.454.light.4.raw

SEQ ID NO: 573229 - DNA, 491 bp, Homo sapiens
  misc_feature: HIJSMM301BTMLA.21.47.E03.1.454.light.4.raw
tcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttagcctggtatcagcagaaaccaggaaaagcccctaaactcctgatctatgctgcatccacgttgcaaagtggagtcccgtcaaggttcagcggcagtgggtctgggacggatttcaatctcaccatcaccagcctgcagcctgaagattttgcaacttattattgtcaacaggctaacagttttcctctcacgttcggcggaggaccaacgtggaggtcaacgaactgtggctgcaccatctgtt

SEQ ID NO: 573230 - DNA, 501 bp, Homo sapiens
  misc_feature: HIJSMM301C398C.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttccgctcactttcggcggagggaccaaggtggagatcaaacgaactgtggctgcaccatctgtcttcatcttccccg

SEQ ID NO: 573231 - DNA, 495 bp, Homo sapiens; identical to SEQ ID NO: 535596
  misc_feature: HIJSMM301BGJSS.10.79.H02.1.454.light.4.raw

SEQ ID NO: 573232 - DNA, 510 bp, Homo sapiens
  misc_feature: HIJSMM301AGQCV.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtcctcgtcagcccaaggctgccccctcggtcactctgttcccgt

SEQ ID NO: 573233 - DNA, 501 bp, Homo sapiens
  misc_feature: HIJSMM301B2P8Q.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggtcggagggaccgagggtggaggatacaaacgaactagtggcgtgcaccactctgtcttctatt

SEQ ID NO: 573234 - DNA, 505 bp, Homo sapiens; identical to SEQ ID NO: 563905
  misc_feature: HIJSMM301B6U6O.18.37.D04.1.454.light.4.raw

SEQ ID NO: 573235 - DNA, 481 bp, Homo sapiens
  misc_feature: HIJSMM301CKVXM.43.24.C02.1.454.light.4.raw
tgtgagtagtcacgaccggtgctcgatttagtacagatcgttagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcgagggccaaggtggagatcaaacgaa

SEQ ID NO: 573236 - DNA, 479 bp, Homo sapiens
  misc_feature: HIJSMM301DIG9Q.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 573237 - DNA, 502 bp, Homo sapiens
  misc_feature: HIJSMM301BXWJA.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtctttcggaattgggacgacggtcaccgtcctaggtcagcccaaggccaaccccta

SEQ ID NO: 573238 - DNA, 479 bp, Homo sapiens; identical to SEQ ID NO: 535586
  misc_feature: HIJSMM301BP8TE.13.34.D01.1.454.light.4.raw

SEQ ID NO: 573239 - DNA, 463 bp, Homo sapiens; identical to SEQ ID NO: 535008
  misc_feature: HIJSMM301BSFFY.10.9.A09.1.454.light.4.raw

SEQ ID NO: 573240 - DNA, 500 bp, Homo sapiens
  misc_feature: HIJSMM301CD871.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaaactagtggctgcaccat

SEQ ID NO: 573241 - DNA, 495 bp, Homo sapiens; identical to SEQ ID NO: 535007
  misc_feature: HIJSMM301CI9T5.22.5.A05.1.454.light.4.raw

SEQ ID NO: 573242 - DNA, 505 bp, Homo sapiens; identical to SEQ ID NO: 535503
  misc_feature: HIJSMM301AJ8JL.8.28.C06.1.454.light.4.raw

SEQ ID NO: 573243 - DNA, 444 bp, Homo sapiens; identical to SEQ ID NO: 536685
  misc_feature: HIJSMM301AROH9.10.76.G10.1.454.light.4.raw

SEQ ID NO: 573244 - DNA, 476 bp, Homo sapiens
  misc_feature: HIJSMM301BFY19.48.83.H06.1.454.light.4.raw
agtatacatacacgaccggtgctcgatttagatcacgtgcgtcgcggggctccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcct

SEQ ID NO: 573245 - DNA, 509 bp, Homo sapiens; identical to SEQ ID NO: 541168
  misc_feature: HIJSMM301CQF64.5.60.F05.1.454.light.4.raw

SEQ ID NO: 573246 - DNA, 484 bp, Homo sapiens; identical to SEQ ID NO: 536162
  misc_feature: HIJSMM301C2WQK.13.59.F04.1.454.light.4.raw

SEQ ID NO: 573247 - DNA, 482 bp, Homo sapiens
  misc_feature: HIJSMM301AIK3W.43.24.C02.1.454.light.4.raw
tgtgagtagtcacgaccggtgctcgatttagtacagatcgttagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcgagggaccaaggtggagatcaaacgaa

SEQ ID NO: 573248 - DNA, 494 bp, Homo sapiens; identical to SEQ ID NO: 534994
  misc_feature: HIJSMM301AOUGM.27.78.H01.1.454.light.4.raw

SEQ ID NO: 573249 - DNA, 499 bp, Homo sapiens
  misc_feature: HIJSMM301EURO5.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttactctcaccatcaccagccttcaggctgaagatgtggcagtttattactgtcaccaatatttagacattcctccgacgttcggccaaagggaccaaggtggagatcaaacgaactgtggctgcaccatctgt

SEQ ID NO: 573250 - DNA, 493 bp, Homo sapiens
  misc_feature: HIJSMM301D0D56.43.79.H02.1.454.light.4.raw
tgtgagtagtcacgaccggtgctcgatttagtgtcacacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactgtggctgcaccatctgtcttcta

SEQ ID NO: 573251 - DNA, 495 bp, Homo sapiens
  misc_feature: HIJSMM301EXZKE.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgttgctccgtacacttttggccaggggacccaggtggagatcagacgaactgtggctgcaccatctgtcttcatcttcccg

SEQ ID NO: 573252 - DNA, 494 bp, Homo sapiens
  misc_feature: HIJSMM301BM251.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcacgggtcccgtcgaccggttctctggctccaagtctggctcttccgcctccttggccatcactgggctcgaggctgacgatgaggctgattactactgtctgtcctatgacgacgacctacagactccggttttcggtcggagggactaagctgaccgtcctaagt

SEQ ID NO: 573253 - DNA, 486 bp, Homo sapiens; identical to SEQ ID NO: 537310
  misc_feature: HIJSMM301AYAGS.15.28.C06.1.454.light.4.raw

SEQ ID NO: 573254 - DNA, 513 bp, Homo sapiens
  misc_feature: HIJSMM301CE0UX.48.81.H04.1.454.light.4.raw
agtatacatacacgaccggtgctcgatttagtagtgtagattcgcgggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacagcccccaaactcctcatttatgacaataataagcgaccctcaggaattcctgaccgattctctggctccaagtctggcacgtcagccaccctgggcatcaccggactccagactggggacgaggccgattattactgcggaacatgggataacagcccgagtggtggccgggtcttcggcggagggaccaagctgaccgtcctacgtcagcccaaggctgccccccg

SEQ ID NO: 573255 - DNA, 504 bp, Homo sapiens
  misc_feature: HIJSMM301B36SY.48.87.H10.1.454.light.4.raw
agtatacatacacgaccggtgctcgatttagcagtactgcgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 573256 - DNA, 474 bp, Homo sapiens; identical to SEQ ID NO: 552964
  misc_feature: HIJSMM301A2003.15.81.H04.1.454.light.4.raw

SEQ ID NO: 573257 - DNA, 444 bp, Homo sapiens; identical to SEQ ID NO: 535192
  misc_feature: HIJSMM301ARY9I.5.9.A09.1.454.light.4.raw

SEQ ID NO: 573258 - DNA, 490 bp, Homo sapiens
  misc_feature: HIJSMM301CSVB6.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgatttattactgttgctcatatgcaggcggtaccgcttgggtgttcggcggagggaccaagctgaccgtcctaggtcagccccg

SEQ ID NO: 573259 - DNA, 479 bp, Homo sapiens
  misc_feature: HIJSMM301CYGRM.52.73.G07.1.454.light.4.raw
cgcagtacgacacgaccggtgctcgatttagctctacgctcaggggactgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggccaggggaccaagctggagatcaaacgaa

SEQ ID NO: 573260 - DNA, 522 bp, Homo sapiens
  misc_feature: HIJSMM301B8I3C.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagcgacacttgggtgttcggcggagggaccaggctgaccgtcctaggtcagcccaaggctgccccctcggtccactctgttcccgccct

SEQ ID NO: 573261 - DNA, 495 bp, Homo sapiens; identical to SEQ ID NO: 568500
  misc_feature: HIJSMM301AEPNT.5.12.B01.1.454.light.4.raw

SEQ ID NO: 573262 - DNA, 514 bp, Homo sapiens
  misc_feature: HIJSMM301EDHV2.48.14.B03.1.454.light.4.raw
  modified_base (461)..(461): a, c, t, g, unknown or other
agtatacatacacgaccggtgctcgatttagtgtgagtagttccgcgggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacagcccccaaactcctcatttatgacaataataagcgaccctcaggaattcctgaccgattctctggctccaagtctggcacgtcagccaccctgggcatcaccggactccagactggggacgaggccgattattactgcggaacatgggataacagcccgagtggtggccgggtnttcggcggagggaccaagctgaccgtcctacgtcagcccaaggctgccccccg

SEQ ID NO: 573263 - DNA, 503 bp, Homo sapiens
  misc_feature: HIJSMM301BTE0Y.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccgaacgagtcggagatcaaccgaaccgtgtggcgtgcaccactctgtt

SEQ ID NO: 573264 - DNA, 505 bp, Homo sapiens
  misc_feature: HIJSMM301B2IVO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcttcggcctaagggaccgaaggtggaaatacaaacgaactagtggctgcaccatctgtcttcatcttccccg

SEQ ID NO: 573265 - DNA, 493 bp, Homo sapiens; identical to SEQ ID NO: 547772
  misc_feature: HIJSMM301BMZBP.47.64.F09.1.454.light.4.raw

SEQ ID NO: 573266 - DNA, 463 bp, Homo sapiens; identical to SEQ ID NO: 535062
  misc_feature: HIJSMM301DRGUI.11.73.G07.1.454.light.4.raw

SEQ ID NO: 573267 - DNA, 472 bp, Homo sapiens
  misc_feature: HIJSMM301EH07K.3.1.A01.1.454.light.4.raw
agacgcactccacgaccggtgctcgatttagacgtctcatcaggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcacat

SEQ ID NO: 573268 - DNA, 506 bp, Homo sapiens
  misc_feature: HIJSMM301EM0AI.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccgaaggtgaccgtcctaggtcagcccaaggctgccccctcggtcactctcg

SEQ ID NO: 573269 - DNA, 510 bp, Homo sapiens
  misc_feature: HIJSMM301CCDEN.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcagggtctacagcctgaagattttgcgacttactattgtcaacagagttaccttctcccccggacgttcgtccaacggaccgaacggtaggaaagtacaagacgaactacgtggcgtgcgaccactctgtcttctatt

SEQ ID NO: 573270 - DNA, 501 bp, Homo sapiens
  misc_feature: HIJSMM301EDD8U.49.82.H05.1.454.light.4.raw
agtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgtcctgactcagcctgcctccgtgtctgggtctcctggacagtcgatcaccatctcctgcactgaaaccagcagtgatgttgggaattataaccttttctcctggtaccaacaacacccaggcaaagccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaaggctgccccctcggt

SEQ ID NO: 573271 - DNA, 488 bp, Homo sapiens
  misc_feature: HIJSMM301DBXC9.53.22.B11.1.454.light.4.raw
cgcgtatacacacgaccggtgctcgatttagacgacagctcagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 573272 - DNA, 497 bp, Homo sapiens; identical to SEQ ID NO: 538825
  misc_feature: HIJSMM301BSYWR.3.10.A10.1.454.light.4.raw

SEQ ID NO: 573273 - DNA, 483 bp, Homo sapiens
  misc_feature: HIJSMM301CLOU0.19.71.G05.1.454.light.4.raw
  modified_base (475)..(475): a, c, t, g, unknown or other
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcacaatattattataacttctggacgtgtcacggacacgaggagatacanagacagtg

SEQ ID NO: 573274 - DNA, 505 bp, Homo sapiens; identical to SEQ ID NO: 571799
  misc_feature: HIJSMM301A5BFS.8.28.C06.1.454.light.4.raw

SEQ ID NO: 573275 - DNA, 483 bp, Homo sapiens
  misc_feature: HIJSMM301E3MFY.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctccagggagtctcggagagattctctgcatccaggtcaggatacacagcctccctgaccattactggactccagcctgaggacgaggctgactattactgctcagcatgggacagcagcctccgtcggtgtggtgatcggcggagggaccgacggcgtgaccgtccct

SEQ ID NO: 573276 - DNA, 489 bp, Homo sapiens; identical to SEQ ID NO: 535139
  misc_feature: HIJSMM301BFRFZ.14.55.E11.1.454.light.4.raw

SEQ ID NO: 573277 - DNA, 441 bp, Homo sapiens; identical to SEQ ID NO: 534971
  misc_feature: HIJSMM301AM2ZV.11.3.A03.1.454.light.4.raw

SEQ ID NO: 573278 - DNA, 497 bp, Homo sapiens; identical to SEQ ID NO: 535692
  misc_feature: HIJSMM301DMS1V.7.59.F04.1.454.light.4.raw

SEQ ID NO: 573279 - DNA, 487 bp, Homo sapiens
  misc_feature: HIJSMM301A33L6.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggctcaggacttatgtcttcggaactgggacccacgttaccgtcctaggtcagaccccg

SEQ ID NO: 573280 - DNA, 468 bp, Homo sapiens
  misc_feature: HIJSMM301C9EFM.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcagggtcccatctcgattcagtggcagtggatctgggacagatttcactctcaccatcagcagcctgcagcctgaagatgttgcaacttattactgtacaaaagaatagcgctgccccgctcagtttcggcggagggaccaaggtggagataacg

SEQ ID NO: 573281 - DNA, 476 bp, Homo sapiens; identical to SEQ ID NO: 536632
  misc_feature: HIJSMM301EA64K.52.1.A01.1.454.light.4.raw

SEQ ID NO: 573282 - DNA, 490 bp, Homo sapiens; identical to SEQ ID NO: 565312
  misc_feature: HIJSMM301ANEO5.48.37.D04.1.454.light.4.raw

SEQ ID NO: 573283 - DNA, 504 bp, Homo sapiens; identical to SEQ ID NO: 535561
  misc_feature: HIJSMM301DKD2Z.4.57.F02.1.454.light.4.raw

SEQ ID NO: 573284 - DNA, 505 bp, Homo sapiens; identical to SEQ ID NO: 535503
  misc_feature: HIJSMM301BR6N0.8.28.C06.1.454.light.4.raw

SEQ ID NO: 573285 - DNA, 501 bp, Homo sapiens
  misc_feature: HIJSMM301D8B47.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcattctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggactggacaaggtcaccgtcctaggtcagccaacggcccaacccactgtcta

SEQ ID NO: 573286 - DNA, 518 bp, Homo sapiens
  misc_feature: HIJSMM301CDQVE.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgagggaccgaacggtaggaaggtacaaacgaactagtggcgtcgcgaccatctgttcttctactttcccgtccact

SEQ ID NO: 573287 - DNA, 501 bp, Homo sapiens
  misc_feature: HIJSMM301C0G1X.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagtcgtacgcctcggtcggacgccgacccgaacgcgtcccgtccccgtcgg

SEQ ID NO: 573288 - DNA, 504 bp, Homo sapiens
  misc_feature: HIJSMM301C2O9W.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaggtcacgtcctaggtcagcccaaggccaacccactgtcact

SEQ ID NO: 573289 - DNA, 483 bp, Homo sapiens; identical to SEQ ID NO: 536202
  misc_feature: HIJSMM301DIJKC.43.24.C02.1.454.light.4.raw

SEQ ID NO: 573290 - DNA, 484 bp, Homo sapiens; identical to SEQ ID NO: 535240
  misc_feature: HIJSMM301EAVYY.47.60.F05.1.454.light.4.raw

SEQ ID NO: 573291 - DNA, 463 bp, Homo sapiens; identical to SEQ ID NO: 535062
  misc_feature: HIJSMM301BC763.11.73.G07.1.454.light.4.raw

SEQ ID NO: 573292 - DNA, 494 bp, Homo sapiens; identical to SEQ ID NO: 534992
  misc_feature: HIJSMM301EIO4K.9.1.A01.1.454.light.4.raw

SEQ ID NO: 573293 - DNA, 490 bp, Homo sapiens
  misc_feature: HIJSMM301DQVFO.19.10.A10.1.454.light.4.raw
tactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagatttgcagtgtattactgtcaacgatatgatgagtcacctccgtggtggacatttggccaggggaccaaggttgaagtcaaacgaactgtgg

SEQ ID NO: 573294 - DNA, 476 bp, Homo sapiens
  misc_feature: HIJSMM301E13XL.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaaggacacgactggagattaaacgaactgtggctgcaccta

SEQ ID NO: 573295 - DNA, 454 bp, Homo sapiens; identical to SEQ ID NO: 535005
  misc_feature: HIJSMM301AHU20.19.86.H09.1.454.light.4.raw

SEQ ID NO: 573296 - DNA, 485 bp, Homo sapiens; identical to SEQ ID NO: 538533
  misc_feature: HIJSMM301DMWHR.47.78.H01.1.454.light.4.raw

SEQ ID NO: 573297 - DNA, 505 bp, Homo sapiens; identical to SEQ ID NO: 535503
  misc_feature: HIJSMM301BD2KY.8.28.C06.1.454.light.4.raw

SEQ ID NO: 573298 - DNA, 380 bp, Homo sapiens
  misc_feature: HIJSMM301CILR8.14.85.H08.1.454.light.4.raw
cgtctagtaccacgaccggtgctcgatttagtatcactcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgccagtcagtaacaatttcggggttttcggcggagggaccaagctgaccgtcctaagtcagcccaaggctgccccctcggtcactctgttcccaccctcctcgtactagacg

SEQ ID NO: 573299 - DNA, 444 bp, Homo sapiens; identical to SEQ ID NO: 535027
  misc_feature: HIJSMM301ARE8D.8.73.G07.1.454.light.4.raw

SEQ ID NO: 573300 - DNA, 491 bp, Homo sapiens; identical to SEQ ID NO: 536549
  misc_feature: HIJSMM301C6DRF.47.55.E11.1.454.light.4.raw

SEQ ID NO: 573301 - DNA, 452 bp, Homo sapiens
  misc_feature: HIJSMM301C7T5X.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgtccgccctcctccacgagagta

SEQ ID NO: 573302 - DNA, 497 bp, Homo sapiens
  misc_feature: HIJSMM301BBOS5.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctggggacagacttcactctcaccatcagcggcctagagcctgagactttgcagtttattactgtcagcagcgtaccaactggccgctcactttcggcggagggaccaaggtggagatcaaacgaactagtggctgcaccatctgtcttcatt

SEQ ID NO: 573303 - DNA, 484 bp, Homo sapiens
  misc_feature: HIJSMM301CUXBD.40.81.H04.1.454.light.4.raw
tctagcgactcacgaccggtgctcgatttagtagtgtagattcgcggggtgactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggtatttattactgcatgcaacctctacaactgtgtggacggtcggccaagggaccaaggtggaaatcaagcgaa

SEQ ID NO: 573304 - DNA, 490 bp, Homo sapiens; identical to SEQ ID NO: 535234
  misc_feature: HIJSMM301EHFE5.17.21.B10.1.454.light.4.raw

SEQ ID NO: 573305 - DNA, 507 bp, Homo sapiens; identical to SEQ ID NO: 564208
  misc_feature: HIJSMM301CM67Z.5.24.C02.1.454.light.4.raw

SEQ ID NO: 573306 - DNA, 486 bp, Homo sapiens; identical to SEQ ID NO: 535043
  misc_feature: HIJSMM301C71V9.46.35.D02.1.454.light.4.raw

SEQ ID NO: 573307 - DNA, 352 bp, Homo sapiens; identical to SEQ ID NO: 535995
  misc_feature: HIJSMM301ECFVO.4.67.G01.1.454.light.4.raw

SEQ ID NO: 573308 - DNA, 482 bp, Homo sapiens
  misc_feature: HIJSMM301D6TB9.13.6.A06.1.454.light.4.raw
tcacgtactacacgaccggtgctcgatttagatctactgacaggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggcctcaggggtccctgatcgcttctctgcctccaagtctggcaacacggcctcctgaccatctctgggctccaggctgaggatgagtctgattattactgctgctcatatgcaggcagctacactgtactattcggcggagggaccaaggctgaccgtcctaggtcagcccaa

SEQ ID NO: 573309 - DNA, 502 bp, Homo sapiens
  misc_feature: HIJSMM301C8V78.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgctagtttattactgtcagcagcgggcaattggccgctcactttcggcgggggaccgaaggtggagttcaacgaactgtggctgcaccatctgtcttcatcttcccg

SEQ ID NO: 573310 - DNA, 496 bp, Homo sapiens; identical to SEQ ID NO: 566246
  misc_feature: HIJSMM301EZ452.9.1.A01.1.454.light.4.raw

SEQ ID NO: 573311 - DNA, 494 bp, Homo sapiens; identical to SEQ ID NO: 545825
  misc_feature: HIJSMM301DUATY.48.48.E04.1.454.light.4.raw

SEQ ID NO: 573312 - DNA, 504 bp, Homo sapiens; identical to SEQ ID NO: 554247
  misc_feature: HIJSMM301APOMF.19.78.H01.1.454.light.4.raw

SEQ ID NO: 573313 - DNA, 495 bp, Homo sapiens; identical to SEQ ID NO: 535821
  misc_feature: HIJSMM301CYL6J.3.31.C09.1.454.light.4.raw

SEQ ID NO: 573314 - DNA, 484 bp, Homo sapiens; identical to SEQ ID NO: 551470
  misc_feature: HIJSMM301AINRC.10.1.A01.1.454.light.4.raw

SEQ ID NO: 573315 - DNA, 447 bp, Homo sapiens; identical to SEQ ID NO: 535201
  misc_feature: HIJSMM301EYQFB.18.9.A09.1.454.light.4.raw

SEQ ID NO: 573316 - DNA, 492 bp, Homo sapiens
  misc_feature: HIJSMM301D7LOU.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggccgggggaccgaaggtggagatcaagcgaactgtggctgcaccatctgtcttcatcttcccg

SEQ ID NO: 573317 - DNA, 511 bp, Homo sapiens; identical to SEQ ID NO: 548439
  misc_feature: HIJSMM301AFF1P.16.46.E02.1.454.light.4.raw

SEQ ID NO: 573318 - DNA, 484 bp, Homo sapiens; identical to SEQ ID NO: 538770
  misc_feature: HIJSMM301EYROT.4.57.F02.1.454.light.4.raw

SEQ ID NO: 573319 - DNA, 493 bp, Homo sapiens
  misc_feature: HIJSMM301C9OO0.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtaggaaatcaaacgaactgtggctgcaccatctgtcttcatcttcccgccat

SEQ ID NO: 573320 - DNA, 500 bp, Homo sapiens
  misc_feature: HIJSMM301D8DRR.2.49.E05.1.454.light.4.raw
acgctcgacacacgaccggtgctcgatttagagcgactagcaacacacaaagggggggaggctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcctaggt

SEQ ID NO: 573321 - DNA, 447 bp, Homo sapiens; identical to SEQ ID NO: 535020
  misc_feature: HIJSMM301EB8VL.18.9.A09.1.454.light.4.raw

SEQ ID NO: 573322 - DNA, 509 bp, Homo sapiens
  misc_feature: HIJSMM301DBGGR.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtctgggtcagccaaggctgcccctcggtcactctgttcccgccct

SEQ ID NO: 573323 - DNA, 514 bp, Homo sapiens
  misc_feature: HIJSMM301EXHHR.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcgctacgtaga

SEQ ID NO: 573324 - DNA, 496 bp, Homo sapiens
  misc_feature: HIJSMM301AURM4.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgactgtggctgcaccatctgtcttcatcttcccgccat

SEQ ID NO: 573325 - DNA, 515 bp, Homo sapiens; identical to SEQ ID NO: 538805
  misc_feature: HIJSMM301AUPLC.14.19.B08.1.454.light.4.raw

SEQ ID NO: 573326 - DNA, 494 bp, Homo sapiens; identical to SEQ ID NO: 535629
  misc_feature: HIJSMM301AWWFH.4.27.C05.1.454.light.4.raw

SEQ ID NO: 573327 - DNA, 500 bp, Homo sapiens; identical to SEQ ID NO: 542247
  misc_feature: HIJSMM301ESCWI.19.78.H01.1.454.light.4.raw

SEQ ID NO: 573328 - DNA, 490 bp, Homo sapiens; identical to SEQ ID NO: 535526
  misc_feature: HIJSMM301CJWJ4.26.78.H01.1.454.light.4.raw

SEQ ID NO: 573329 - DNA, 503 bp, Homo sapiens
  misc_feature: HIJSMM301EW7F9.48.35.D02.1.454.light.4.raw
agtatacatacacgaccggtgctcgatttagcacacgatagttgggtttggggggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 573330 - DNA, 489 bp, Homo sapiens
  misc_feature: HIJSMM301DIYOM.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagattttcactctcaccatcagcagtctgcaacctgaagattttgcaacttactactgtcaacagagttacggtaccccgtacacttttggccaggggaccaaactggacatcaaacgaactgtggctgcaccatctgtt

SEQ ID NO: 573331 - DNA, 512 bp, Homo sapiens; identical to SEQ ID NO: 556539
  misc_feature: HIJSMM301C0D40.5.58.F03.1.454.light.4.raw

SEQ ID NO: 573332 - DNA, 476 bp, Homo sapiens
  misc_feature: HIJSMM301EQOTM.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgccgctatgtcttcggaactgggaccaaaggtcaccgtctaacgtcacgacccg

SEQ ID NO: 573333 - DNA, 472 bp, Homo sapiens; identical to SEQ ID NO: 536302
  misc_feature: HIJSMM301ANEH2.18.76.G10.1.454.light.4.raw

SEQ ID NO: 573334 - DNA, 494 bp, Homo sapiens
  misc_feature: HIJSMM301AM0LU.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaacggtggaggatacaaacgaacct

SEQ ID NO: 573335 - DNA, 484 bp, Homo sapiens; identical to SEQ ID NO: 544273
  misc_feature: HIJSMM301E31A2.53.32.C10.1.454.light.4.raw

SEQ ID NO: 573336 - DNA, 505 bp, Homo sapiens; identical to SEQ ID NO: 535987
  misc_feature: HIJSMM301AGSHG.18.37.D04.1.454.light.4.raw

SEQ ID NO: 573337 - DNA, 504 bp, Homo sapiens; identical to SEQ ID NO: 549905
  misc_feature: HIJSMM301EQB6K.48.71.G05.1.454.light.4.raw

SEQ ID NO: 573338 - DNA, 493 bp, Homo sapiens; identical to SEQ ID NO: 571618
  misc_feature: HIJSMM301BPRE4.9.1.A01.1.454.light.4.raw

SEQ ID NO: 573339 - DNA, 489 bp, Homo sapiens
  misc_feature: HIJSMM301AUGSZ.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttcccctcactttcggcggaggaccaaggtggagatcaagcgaactgtggctgcaccatctgtctt

SEQ ID NO: 573340 - DNA, 507 bp, Homo sapiens; identical to SEQ ID NO: 535641
  misc_feature: HIJSMM301EWC2O.10.88.H11.1.454.light.4.raw

SEQ ID NO: 573341 - DNA, 519 bp, Homo sapiens; identical to SEQ ID NO: 560915
  misc_feature: HIJSMM301BNBAW.27.23.C01.1.454.light.4.raw

SEQ ID NO: 573342 - DNA, 506 bp, Homo sapiens; identical to SEQ ID NO: 538849
  misc_feature: HIJSMM301C4XMS.43.15.B04.1.454.light.4.raw

SEQ ID NO: 573343 - DNA, 485 bp, Homo sapiens; identical to SEQ ID NO: 543180
  misc_feature: HIJSMM301CBMKT.3.10.A10.1.454.light.4.raw

SEQ ID NO: 573344 - DNA, 485 bp, Homo sapiens; identical to SEQ ID NO: 535606
  misc_feature: HIJSMM301AJLUA.47.46.E02.1.454.light.4.raw

SEQ ID NO: 573345 - DNA, 444 bp, Homo sapiens; identical to SEQ ID NO: 535192
  misc_feature: HIJSMM301AY3C5.5.9.A09.1.454.light.4.raw

SEQ ID NO: 573346 - DNA, 506 bp, Homo sapiens
  misc_feature: HIJSMM301B59E4.40.57.F02.1.454.light.4.raw
tctagcgactcacgaccggtgctcgatttagctcgatatagttgggtttggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctactttattttgctgtcttcttatgcaggctagttcgctctacgaagttcgttcgggcggacgggaccgagcgtcgaccgtcctacgtcacgcccgaac

SEQ ID NO: 573347 - DNA, 487 bp, Homo sapiens
  misc_feature: HIJSMM301CFYQY.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttacccgtcctaggtcagaccc

SEQ ID NO: 573348 - DNA, 490 bp, Homo sapiens
  misc_feature: HIJSMM301DGV5O.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctctactttcggcggagggaccaaggtggagatacaaacgaactgtc

SEQ ID NO: 573349 - DNA, 484 bp, Homo sapiens
  misc_feature: HIJSMM301B022L.51.15.B04.1.454.light.4.raw
cgatcgtatacacgaccggtgctcgatttagacagtatatatccgcgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtattggatacaactatttggattggcacctgcagaagccagggcagtctccacaggtcctgatctatttgagttctaatcgggccccggggtccctgacaggttcagtggcagtggatcaggcacagattttatactgaaaatcagcagagtggaggctgaggatgttggggtttatcattgcatgcaagctctacaaactcctctagacttcggcggagggaccgaaggtggagatcaagcgaactgt

SEQ ID NO: 573350 - DNA, 508 bp, Homo sapiens
  misc_feature: HIJSMM301A6W7E.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgacctaccaaaggagaaagtcaccatcacctgccgggccagtcagagcgttggtagtagcttacactggtaccagcagaagccaggtcagtctaccaaagctcctcatcaagtatgcttcccagtccttctcacggggtcccctcgaggttcagtggcagtggatcgtgggacacatttcaccctcaccatcaatagcctggaagctgaagatgctgcaacttattactgtcatcagagtactactttacctcaagtgatcaccttcggccaagggacacgactggagattaaacg

SEQ ID NO: 573351 - DNA, 480 bp, Homo sapiens; identical to SEQ ID NO: 535630
  misc_feature: HIJSMM301C3K30.40.59.F04.1.454.light.4.raw

SEQ ID NO: 573352 - DNA, 520 bp, Homo sapiens
  misc_feature: HIJSMM301CZ0DT.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccgaagggaccaaggtggcaagtcaaccgaactgtggctgcaccatctgtcttcatcttccccg

SEQ ID NO: 573353 - DNA, 484 bp, Homo sapiens; identical to SEQ ID NO: 553263
  misc_feature: HIJSMM301B4PKB.46.26.C04.1.454.light.4.raw
  modified_base (445)..(445): a, c, t, g, unknown or other

SEQ ID NO: 573354 - DNA, 473 bp, Homo sapiens
  misc_feature: HIJSMM301BLYYV.48.41.D08.1.454.light.4.raw
agtatacatacacgaccggtgctcgatttagtcacgcgagaaagggaaaggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtcacctggtaccaacaacacgcaggcaaagcccccaaactcatgatttatgatgtcactaagcggccctcagggtccctgctcgcttctctggctccaagtctggcaacacggcctccctgaccatctctgggctccaggctgaagatgaggctgattatttctgctgctcatatgcagccaatattatgtcttcggaactgagaccaaggtcaccgtct

SEQ ID NO: 573355 - DNA, 491 bp, Homo sapiens
  misc_feature: HIJSMM301EXT1W.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtctt

SEQ ID NO: 573356 - DNA, 489 bp, Homo sapiens
  misc_feature: HIJSMM301CAT3B.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgagatgttgggtttgttcctcatgcaaggtacacactggccttttggccagggggaccaacctggagatcaaatgaactgtggctgcacatctgtct

SEQ ID NO: 573357 - DNA, 481 bp, Homo sapiens
  misc_feature: HIJSMM301A51E7.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctccactttcggcggagggaccaaggtggagatcaaacgaactgtggctgcaa

SEQ ID NO: 573358 - DNA, 515 bp, Homo sapiens; identical to SEQ ID NO: 571181
  misc_feature: HIJSMM301AI4T4.13.4.A04.1.454.light.4.raw

SEQ ID NO: 573359 - DNA, 488 bp, Homo sapiens
  misc_feature: HIJSMM301A8W2J.41.44.D11.1.454.light.4.raw
tctatactatcacgaccggtgctcgatttagcgcagtacgaagggggctgcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactggaacttatcgtcctaggtcagcccaa

SEQ ID NO: 573360 - DNA, 512 bp, Homo sapiens; identical to SEQ ID NO: 565543
  misc_feature: HIJSMM301ECNSK.15.34.D01.1.454.light.4.raw

SEQ ID NO: 573361 - DNA, 480 bp, Homo sapiens
  misc_feature: HIJSMM301BDWSF.40.15.B04.1.454.light.4.raw
tctagcgactcacgaccggtgctcgatttagacagtatatatccgcgggaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgttggcaaccaaggagcaacttggctgcagcagcaccagggccaccctcccaaagtcctatccgacaggaataacaaccggccctcagggatctcagagagaatatctgcatccaggtcaggaaacacagcctccctgaccattactggactccagcctgaggacgaggctgactattattgctcagcatgggacaccagcctcaatgccgcagtattcggcgcagggaccaagctgaccgtcctaggtcacg

SEQ ID NO: 573362 - DNA, 487 bp, Homo sapiens
  misc_feature: HIJSMM301COY6M.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccgaaggtggaaatacaaacgaactagtggctgcaccta

SEQ ID NO: 573363 - DNA, 498 bp, Homo sapiens
  misc_feature: HIJSMM301DAGCC.22.27.C05.1.454.light.4.raw
acatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatacaacgaactgtggctgcacca

SEQ ID NO: 573364 - DNA, 506 bp, Homo sapiens; identical to SEQ ID NO: 542696
  misc_feature: HIJSMM301CYNMC.7.71.G05.1.454.light.4.raw

SEQ ID NO: 573365 - DNA, 515 bp, Homo sapiens
  misc_feature: HIJSMM301BXGHW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcggtccagggaccgaacggtaggaaagtacaaacgaacctaagtggcgtgcgaccactctcgtcttctatctttccccg

SEQ ID NO: 573366 - DNA, 502 bp, Homo sapiens; identical to SEQ ID NO: 552832
  misc_feature: HIJSMM301ELYWQ.18.11.A11.1.454.light.4.raw

SEQ ID NO: 573367 - DNA, 501 bp, Homo sapiens; identical to SEQ ID NO: 536142
  misc_feature: HIJSMM301EF88L.15.1.A01.1.454.light.4.raw

SEQ ID NO: 573368 - DNA, 501 bp, Homo sapiens
  misc_feature: HIJSMM301CKXQ0.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctggggacagagttcactctcaccatcagcagcctgcagtctgaagattttgcagtttattattgtcagcagtataataactggcctccgtggacgttcggccaagggaccaaggtggaaatcaaacgaaactgtggctgcaccatctgtcttcta

SEQ ID NO: 573369 - DNA, 477 bp, Homo sapiens; identical to SEQ ID NO: 535506
  misc_feature: HIJSMM301CT63T.7.67.G01.1.454.light.4.raw

SEQ ID NO: 573370 - DNA, 447 bp, Homo sapiens; identical to SEQ ID NO: 535020
  misc_feature: HIJSMM301ERYW3.18.9.A09.1.454.light.4.raw

SEQ ID NO: 573371 - DNA, 498 bp, Homo sapiens
  misc_feature: HIJSMM301CR2OV.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaagtcaaacgaactgtggctgcaccatctgtcttcattcc

SEQ ID NO: 573372 - DNA, 506 bp, Homo sapiens
  misc_feature: HIJSMM301AMY0B.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtca

SEQ ID NO: 573373 - DNA, 487 bp, Homo sapiens
  misc_feature: HIJSMM301C1LS6.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgaccaagggaccaaggtggatatacagacgaa

SEQ ID NO: 573374 - DNA, 487 bp, Homo sapiens; identical to SEQ ID NO: 538190
  misc_feature: HIJSMM301CIYFE.47.70.G04.1.454.light.4.raw

SEQ ID NO: 573375 - DNA, 503 bp, Homo sapiens; identical to SEQ ID NO: 538884
  misc_feature: HIJSMM301CBFI3.27.78.H01.1.454.light.4.raw

SEQ ID NO: 573376 - DNA, 504 bp, Homo sapiens
  misc_feature: HIJSMM301DQR2H.40.67.G01.1.454.light.4.raw
tctagcgactcacgaccggtgctcgatttagagtatacatattgggtttgggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcagtttattactgtcagcagcgtgccaactggcctctcactttcggcggagggaccaaggtggagatcaaacgaactgtggctgcaccatctgtcttcatcttcccgccta

SEQ ID NO: 573377 - DNA, 501 bp, Homo sapiens
  misc_feature: HIJSMM301AXKZ7.18.11.A11.1.454.light.4.raw
tacgagtatgcacgaccggtgctcgatttagctacgactgcagggggatctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 573378 - DNA, 453 bp, Homo sapiens
  misc_feature: HIJSMM301DMRDX.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagaccggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttccgcctcctccacgagagta

SEQ ID NO: 573379 - DNA, 508 bp, Homo sapiens
  misc_feature: HIJSMM301C1UME.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccgggatgaggccgactattactgtcaggtgtgggatagtagtggtgatcatccatacgtcttcggaactgggaccaaggtctccgtcctacgtcagcccaaggccaacccactgtcactctgttcccta

SEQ ID NO: 573380 - DNA, 501 bp, Homo sapiens; identical to SEQ ID NO: 536142
  misc_feature: HIJSMM301BS77B.15.1.A01.1.454.light.4.raw

SEQ ID NO: 573381 - DNA, 514 bp, Homo sapiens
  misc_feature: HIJSMM301B7J2A.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccagggaccgaaggtggaagtcaagcgaactgtggctgcaccatctgtcttcatcttcccgcccta

SEQ ID NO: 573382 - DNA, 490 bp, Homo sapiens; identical to SEQ ID NO: 550493
  misc_feature: HIJSMM301CQDG5.10.59.F04.1.454.light.4.raw

SEQ ID NO: 573383 - DNA, 484 bp, Homo sapiens
  misc_feature: HIJSMM301DOH5A.41.12.B01.1.454.light.4.raw
tctatactatcacgaccggtgctcgatttagtagtgtagattccgcggggaggaatcagacccagtcaggacacagcatggacatgagagtcctcgctcagctcctggggctcctgctgctctgtttcccaggtgccagatgtgacatccagatgacccagtctccgtcctcactgtctgcatctgtgggagacagagtcaccatcacttgtcgggcgagtcaggacattagcaattatttagcctggtttcagcagaaacccggcaacgcccctaaatccctaatctatgctgcatccactttgcgaagtggggtcccgtcaaagttcagcggcggcagatctgggacagacttcactctcaccatcagcaacctgcagcctgaagattttgcaacttattactgccaacaatacagcacgtttcccctcactttcggcggagggaccagggtggaggatcaaacgaactgtggctgcaccat

SEQ ID NO: 573384 - DNA, 482 bp, Homo sapiens
  misc_feature: HIJSMM301DWCX1.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttccggcggaggaccgaaggtggagatcaaacgaactgtggctgcacc

SEQ ID NO: 573385 - DNA, 491 bp, Homo sapiens
  misc_feature: HIJSMM301BTW48.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtcttggtcagcccaaggctgccccctc

SEQ ID NO: 573386 - DNA, 518 bp, Homo sapiens
  misc_feature: HIJSMM301EDIJF.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccgaacggtaggaagtacaagacgaaccgtagtaggcgtgcgaccactctgtcttctactcttcccgtcccc

SEQ ID NO: 573387 - DNA, 504 bp, Homo sapiens; identical to SEQ ID NO: 572162
  misc_feature: HIJSMM301ALIW8.8.24.C02.1.454.light.4.raw

SEQ ID NO: 573388 - DNA, 513 bp, Homo sapiens
  misc_feature: HIJSMM301CDJSS.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccgagtctggcaacacggcctccctgaccatctctgggctccaggctgaggacgaggctgattattactgcaactcacttacaacgaccgacacttgcgttattcggcggcgggaccaagctgaccgtcctaggtcagcccaaggctgccccctggtcactctgtt

SEQ ID NO: 573389 - DNA, 494 bp, Homo sapiens; identical to SEQ ID NO: 534992
  misc_feature: HIJSMM301CW6MC.9.1.A01.1.454.light.4.raw

SEQ ID NO: 573390 - DNA, 524 bp, Homo sapiens
  misc_feature: HIJSMM301A6XV5.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgacggaccgaacggtaggaagtacgaacgaaacgtacgtaggcgtcgtcgaccactactcgtcttctatacttcccgtcccact

SEQ ID NO: 573391 - DNA, 497 bp, Homo sapiens; identical to SEQ ID NO: 535740
  misc_feature: HIJSMM301AGQDU.3.71.G05.1.454.light.4.raw

SEQ ID NO: 573392 - DNA, 501 bp, Homo sapiens; identical to SEQ ID NO: 535746
  misc_feature: HIJSMM301BNPW4.18.11.A11.1.454.light.4.raw

SEQ ID NO: 573393 - DNA, 505 bp, Homo sapiens; identical to SEQ ID NO: 539292
  misc_feature: HIJSMM301BESKD.19.85.H08.1.454.light.4.raw

SEQ ID NO: 573394 - DNA, 520 bp, Homo sapiens
  misc_feature: HIJSMM301D2JO7.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctggtccactctgttcccaccct

SEQ ID NO: 573395 - DNA, 513 bp, Homo sapiens; identical to SEQ ID NO: 535244
  misc_feature: HIJSMM301CWY5U.17.33.C11.1.454.light.4.raw

SEQ ID NO: 573396 - DNA, 488 bp, Homo sapiens; identical to SEQ ID NO: 539884
  misc_feature: HIJSMM301D01IE.7.85.H08.1.454.light.4.raw

SEQ ID NO: 573397 - DNA, 520 bp, Homo sapiens
  misc_feature: HIJSMM301EG46N.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 573398 - DNA, 478 bp, Homo sapiens
  misc_feature: HIJSMM301DV0OW.5.12.B01.1.454.light.4.raw
atcagacacgcacgaccggtgctcgatttagtagtgtagattccgcggggggggtcgtcaggaggcagcgctctcgggacggtctccaccatggcctgggctctgctattcctcaccctcctcactcagggcacagggtccgtgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggtcggagggaccaagctgaccgt

SEQ ID NO: 573399 - DNA, 521 bp, Homo sapiens; identical to SEQ ID NO: 538715
  misc_feature: HIJSMM301AXAVO.27.23.C01.1.454.light.4.raw

SEQ ID NO: 573400 - DNA, 454 bp, Homo sapiens; identical to SEQ ID NO: 534964
  misc_feature: HIJSMM301DMDYG.19.86.H09.1.454.light.4.raw

SEQ ID NO: 573401 - DNA, 503 bp, Homo sapiens; identical to SEQ ID NO: 538973
  misc_feature: HIJSMM301B8RSO.5.86.H09.1.454.light.4.raw

SEQ ID NO: 573402 - DNA, 495 bp, Homo sapiens
  misc_feature: HIJSMM301D76U6.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcacctttcggccaagggacacgactggagattaaacgaactgtggctgcaccatctgtctt

SEQ ID NO: 573403 - DNA, 455 bp, Homo sapiens
  misc_feature: HIJSMM301AHKPZ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctccctccacgagagta

SEQ ID NO: 573404 - DNA, 507 bp, Homo sapiens; identical to SEQ ID NO: 538063
  misc_feature: HIJSMM301CUU18.47.85.H08.1.454.light.4.raw

SEQ ID NO: 573405 - DNA, 510 bp, Homo sapiens
  misc_feature: HIJSMM301B2X2N.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaaggctgaccgtcttaagtcagcccaaggcctgccccctggtcactctgttccca

SEQ ID NO: 573406 - DNA, 463 bp, Homo sapiens; identical to SEQ ID NO: 535062
  misc_feature: HIJSMM301B42QL.11.73.G07.1.454.light.4.raw

SEQ ID NO: 573407 - DNA, 494 bp, Homo sapiens; identical to SEQ ID NO: 535497
  misc_feature: HIJSMM301DR97M.43.72.G06.1.454.light.4.raw

SEQ ID NO: 573408 - DNA, 493 bp, Homo sapiens
  misc_feature: HIJSMM301D2X0G.43.15.B04.1.454.light.4.raw
tgtgagtagtcacgaccggtgctcgatttagacagtatatatccgcgggggaggaactgctcagttaggacccagacggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcaccagtatggtagctcacctaagacgttcggccaagggaccaaggtggaaatcaaacgaactgtggctgcaccatctgtctt

SEQ ID NO: 573409 - DNA, 518 bp, Homo sapiens
  misc_feature: HIJSMM301ASL4N.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgtaggacgagtctacttattactgcagttcctttaattaggcgccactctcgtggttttcggtcggaggcaccgaagtgaccgtcctcggtcagcccaaggctcgccccctcggtcactctcg

SEQ ID NO: 573410 - DNA, 509 bp, Homo sapiens
  misc_feature: HIJSMM301CMU9C.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagccaaggctcgccccctcggtcactctcgttcccaccctccc

SEQ ID NO: 573411 - DNA, 481 bp, Homo sapiens
  misc_feature: HIJSMM301B34MH.11.11.A11.1.454.light.4.raw
cgagagataccacgaccggtgctcgatttagctacgactgcaggggcgagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcacttttcggcggagggaccgcggtggagatcagacgaactgtggctgcacccatctgtctt

SEQ ID NO: 573412 - DNA, 492 bp, Homo sapiens; identical to SEQ ID NO: 534967
  misc_feature: HIJSMM301C4ZTB.47.64.F09.1.454.light.4.raw

SEQ ID NO: 573413 - DNA, 505 bp, Homo sapiens
  misc_feature: HIJSMM301EUCWY.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccccatgtca

SEQ ID NO: 573414 - DNA, 492 bp, Homo sapiens; identical to SEQ ID NO: 536010
  misc_feature: HIJSMM301BTXRK.10.20.B09.1.454.light.4.raw

SEQ ID NO: 573415 - DNA, 494 bp, Homo sapiens; identical to SEQ ID NO: 536444
  misc_feature: HIJSMM301CFM6R.26.72.G06.1.454.light.4.raw

SEQ ID NO: 573416 - DNA, 486 bp, Homo sapiens; identical to SEQ ID NO: 535385
  misc_feature: HIJSMM301AS7P3.19.71.G05.1.454.light.4.raw

SEQ ID NO: 573417 - DNA, 494 bp, Homo sapiens
  misc_feature: HIJSMM301EO21T.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactcccagccaggttcagtggcaggtgggtctgggacagagttcattctcaccatcagcagcctgcagtctgaagtattttgactaatttattactgtcagcagtataataactggtggacgttcggccaagggaccaaggtagaaatacaaacgaactgtggctgcaccatctgtt

SEQ ID NO: 573418 - DNA, 491 bp, Homo sapiens; identical to SEQ ID NO: 535294
  misc_feature: HIJSMM301EG1AA.16.68.G02.1.454.light.4.raw

SEQ ID NO: 573419 - DNA, 504 bp, Homo sapiens; identical to SEQ ID NO: 535935
  misc_feature: HIJSMM301D7QS8.18.78.H01.1.454.light.4.raw

SEQ ID NO: 573420 - DNA, 444 bp, Homo sapiens; identical to SEQ ID NO: 534993
  misc_feature: HIJSMM301EJH0Z.5.9.A09.1.454.light.4.raw

SEQ ID NO: 573421 - DNA, 481 bp, Homo sapiens
  misc_feature: HIJSMM301DQ2ER.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccagggaccaggctggagatcaaacgaactagtggctgcaccatctgt

SEQ ID NO: 573422 - DNA, 492 bp, Homo sapiens
  misc_feature: HIJSMM301BMPU8.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcacctttcggcggagggaccaaggtggagatcaaacgaactgtggctgcaccatctgtt

SEQ ID NO: 573423 - DNA, 508 bp, Homo sapiens
  misc_feature: HIJSMM301CKVUZ.8.42.D09.1.454.light.4.raw
ctcgcgtgtccacgaccggtgctcgatttagacacatacgcagggaaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccgccct

SEQ ID NO: 573424 - DNA, 504 bp, Homo sapiens; identical to SEQ ID NO: 564442
  misc_feature: HIJSMM301BA03W.40.41.D08.1.454.light.4.raw

SEQ ID NO: 573425 - DNA, 521 bp, Homo sapiens; identical to SEQ ID NO: 536990
  misc_feature: HIJSMM301CKD2X.27.23.C01.1.454.light.4.raw
  modified_base (517)..(517): a, c, t, g, unknown or other

SEQ ID NO: 573426 - DNA, 500 bp, Homo sapiens
  misc_feature: HIJSMM301AEXXR.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccgagtctgaccgtcctaggtcagcccaaggctgccccctcggtcactctcg

SEQ ID NO: 573427 - DNA, 494 bp, Homo sapiens; identical to SEQ ID NO: 534994
  misc_feature: HIJSMM301CTVXA.27.78.H01.1.454.light.4.raw

SEQ ID NO: 573428 - DNA, 487 bp, Homo sapiens; identical to SEQ ID NO: 537573
  misc_feature: HIJSMM301AONKZ.3.10.A10.1.454.light.4.raw

SEQ ID NO: 573429 - DNA, 498 bp, Homo sapiens; identical to SEQ ID NO: 540742
  misc_feature: HIJSMM301B28NO.18.59.F04.1.454.light.4.raw

SEQ ID NO: 573430 - DNA, 506 bp, Homo sapiens
  misc_feature: HIJSMM301AIRVV.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaagggaccgaaggtaggaaatacaaacgaactagtggcgtgcaccatctgtcttctactcttccccg

SEQ ID NO: 573431 - DNA, 502 bp, Homo sapiens
  misc_feature: HIJSMM301EU6NW.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctg

SEQ ID NO: 573432 - DNA, 515 bp, Homo sapiens; identical to SEQ ID NO: 557280
  misc_feature: HIJSMM301DJRPX.15.86.H09.1.454.light.4.raw

SEQ ID NO: 573433 - DNA, 493 bp, Homo sapiens
  misc_feature: HIJSMM301CG1L9.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattacttgccaacagtatcatcatcattgtaatttcggtggtagggaccaaggtggaggtcaaacgaactgtggctgcaccatctgtcttcatt

SEQ ID NO: 573434 - DNA, 497 bp, Homo sapiens; identical to SEQ ID NO: 536371
  misc_feature: HIJSMM301CNR4U.16.78.H01.1.454.light.4.raw

SEQ ID NO: 573435 - DNA, 479 bp, Homo sapiens
  misc_feature: HIJSMM301CVRIQ.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttcggcggagggaccgaagctgaccgtcctaagtcagacccg

SEQ ID NO: 573436 - DNA, 517 bp, Homo sapiens
  misc_feature: HIJSMM301CX5VN.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccaagctgaccgtcctaggtcagcccaaggctcgccccctcggtcactctcgttcccgccctcctcagacgtatcac

SEQ ID NO: 573437 - DNA, 491 bp, Homo sapiens
  misc_feature: HIJSMM301DVIVB.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatccaccttcggccaagggacacgactggagattaaacgaactgtggctgcaccatctgtcttcat

SEQ ID NO: 573438 - DNA, 487 bp, Homo sapiens
  misc_feature: HIJSMM301A5ZRM.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtccta

SEQ ID NO: 573439 - DNA, 502 bp, Homo sapiens; identical to SEQ ID NO: 538897
  misc_feature: HIJSMM301DELIQ.21.38.D05.1.454.light.4.raw

SEQ ID NO: 573440 - DNA, 377 bp, Homo sapiens; identical to SEQ ID NO: 536071
  misc_feature: HIJSMM301BN5Q2.40.9.A09.1.454.light.4.raw

SEQ ID NO: 573441 - DNA, 495 bp, Homo sapiens; identical to SEQ ID NO: 535596
  misc_feature: HIJSMM301BONZF.10.79.H02.1.454.light.4.raw

SEQ ID NO: 573442 - DNA, 492 bp, Homo sapiens
  misc_feature: HIJSMM301C7950.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgt

SEQ ID NO: 573443 - DNA, 479 bp, Homo sapiens; identical to SEQ ID NO: 535118
  misc_feature: HIJSMM301AZFZV.13.59.F04.1.454.light.4.raw

SEQ ID NO: 573444 - DNA, 485 bp, Homo sapiens
  misc_feature: HIJSMM301EBUVN.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggcccaagggacacgactggagattaaacgaactgtggctgcaccat

SEQ ID NO: 573445 - DNA, 502 bp, Homo sapiens; identical to SEQ ID NO: 557953
  misc_feature: HIJSMM301EONJ6.15.57.F02.1.454.light.4.raw

SEQ ID NO: 573446 - DNA, 496 bp, Homo sapiens
  misc_feature: HIJSMM301A9PJK.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgacttgggttttattctactttcggccctgggaccaaagtggatttcagacgaactgtggctgcaccatctgtcttcta

SEQ ID NO: 573447 - DNA, 484 bp, Homo sapiens
  misc_feature: HIJSMM301CE18Y.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcgggggaccaagtggacgtcaaacgaactgtggctgcaccta

SEQ ID NO: 573448 - DNA, 505 bp, Homo sapiens; identical to SEQ ID NO: 566747
  misc_feature: HIJSMM301ALV0F.12.48.E04.1.454.light.4.raw

SEQ ID NO: 573449 - DNA, 492 bp, Homo sapiens; identical to SEQ ID NO: 539630
  misc_feature: HIJSMM301DXFHX.22.25.C03.1.454.light.4.raw

SEQ ID NO: 573450 - DNA, 494 bp, Homo sapiens; identical to SEQ ID NO: 536810
  misc_feature: HIJSMM301EHAFL.10.79.H02.1.454.light.4.raw

SEQ ID NO: 573451 - DNA, 511 bp, Homo sapiens
  misc_feature: HIJSMM301AEMAM.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccggacggtacggtaggtagtgtaacgacgaacgtaacgtggtcgtcgtcgaccactacttcg

SEQ ID NO: 573452 - DNA, 500 bp, Homo sapiens
  misc_feature: HIJSMM301APKN8.48.82.H05.1.454.light.4.raw
agtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgtcacctcatatacaagcagcagcactctcgtggtattcggcggagggaccaagctgaccgtcctaggtcagcccaaggctgccccctc

SEQ ID NO: 573453 - DNA, 504 bp, Homo sapiens; identical to SEQ ID NO: 539091
  misc_feature: HIJSMM301EOWHG.8.28.C06.1.454.light.4.raw

SEQ ID NO: 573454 - DNA, 497 bp, Homo sapiens; identical to SEQ ID NO: 535740
  misc_feature: HIJSMM301CMOPQ.3.71.G05.1.454.light.4.raw

SEQ ID NO: 573455 - DNA, 506 bp, Homo sapiens
  misc_feature: HIJSMM301C7ND6.9.71.G05.1.454.light.4.raw
tgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggaggaccaggctgaccgtcctgagtcagcccaaggctcgccccctcggtcactctcgttcccaccctcctcacgg

SEQ ID NO: 573456 - DNA, 503 bp, Homo sapiens
  misc_feature: HIJSMM301EPJR4.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcact

SEQ ID NO: 573457 - DNA, 521 bp, Homo sapiens; identical to SEQ ID NO: 538715
  misc_feature: HIJSMM301A3EAY.27.23.C01.1.454.light.4.raw

SEQ ID NO: 573458 - DNA, 494 bp, Homo sapiens; identical to SEQ ID NO: 534992
  misc_feature: HIJSMM301C6FKL.9.1.A01.1.454.light.4.raw

SEQ ID NO: 573459 - DNA, 490 bp, Homo sapiens; identical to SEQ ID NO: 535936
  misc_feature: HIJSMM301D6M9U.16.68.G02.1.454.light.4.raw

SEQ ID NO: 573460 - DNA, 504 bp, Homo sapiens
  misc_feature: HIJSMM301EQZZD.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagttactactttacctcaagtgatcaccttcggccaagggacacgactggagattaaacg

SEQ ID NO: 573461 - DNA, 493 bp, Homo sapiens; identical to SEQ ID NO: 535084
  misc_feature: HIJSMM301E22PP.47.64.F09.1.454.light.4.raw

SEQ ID NO: 573462 - DNA, 384 bp, Homo sapiens
  misc_feature: HIJSMM301DTHYG.48.33.C11.1.454.light.4.raw
agtatacatacacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 573463 - DNA, 496 bp, Homo sapiens
  misc_feature: HIJSMM301BIKVL.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccagggaccaaggtggaatcaaacgaactgtggctgcacc

SEQ ID NO: 573464 - DNA, 501 bp, Homo sapiens; identical to SEQ ID NO: 536142
  misc_feature: HIJSMM301CYOMN.15.1.A01.1.454.light.4.raw

SEQ ID NO: 573465 - DNA, 500 bp, Homo sapiens; identical to SEQ ID NO: 548609
  misc_feature: HIJSMM301D3AQK.17.27.C05.1.454.light.4.raw

SEQ ID NO: 573466 - DNA, 501 bp, Homo sapiens
  misc_feature: HIJSMM301AKOJP.52.27.C05.1.454.light.4.raw
cgcagtacgacacgaccggtgctcgatttagacgcgatcgaagggtttggggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccgccta

SEQ ID NO: 573467 - DNA, 508 bp, Homo sapiens; identical to SEQ ID NO: 536062
  misc_feature: HIJSMM301DSO1E.11.57.F02.1.454.light.4.raw

SEQ ID NO: 573468 - DNA, 501 bp, Homo sapiens
  misc_feature: HIJSMM301DRCBO.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctcaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 573469 - DNA, 504 bp, Homo sapiens; identical to SEQ ID NO: 549418
  misc_feature: HIJSMM301CDZQ0.19.78.H01.1.454.light.4.raw

SEQ ID NO: 573470 - DNA, 491 bp, Homo sapiens; identical to SEQ ID NO: 535194
  misc_feature: HIJSMM301A45WQ.26.78.H01.1.454.light.4.raw

SEQ ID NO: 573471 - DNA, 496 bp, Homo sapiens
  misc_feature: HIJSMM301B7B2D.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatccccagacaggttcagtggcagtgggtctgggacagacttcactctcaccatcagcagactggagcctgaggattttgcagtgtattactgtcagcagtatcataggtcaaacaccttcggccaagggacacgaactggagattaaaggaactgtggctgcaccatctgtcttcatcttccccg

SEQ ID NO: 573472 - DNA, 487 bp, Homo sapiens
  misc_feature: HIJSMM301DFB83.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaattcggtgagggaccaaggtggaggtcaaagaactgtggctgcaccatctgtcttcat

SEQ ID NO: 573473 - DNA, 497 bp, Homo sapiens; identical to SEQ ID NO: 537943
  misc_feature: HIJSMM301CU3HS.21.15.B04.1.454.light.4.raw

SEQ ID NO: 573474 - DNA, 482 bp, Homo sapiens; identical to SEQ ID NO: 535216
  misc_feature: HIJSMM301DBB8G.17.26.C04.1.454.light.4.raw

SEQ ID NO: 573475 - DNA, 501 bp, Homo sapiens
  misc_feature: HIJSMM301AZ8W9.40.58.F03.1.454.light.4.raw
tctagcgactcacgaccggtgctcgatttagtctgatcgagaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacaccgccatgaacaaggagtacttggcttggttccagcagaaagcagggcagccccctaagctgctcatttactcggcatccacccggaaatccggagttcctgaccgattccgtggcagcgggtctgggacagattttactctcaccatcagtagcctgcagactgaagatgtggcagtttattactgtcaacaatattttcatactccgccgacgttcggccggggaccgaacgtggaaatcaaacgaactgtggctgcaccat

SEQ ID NO: 573476 - DNA, 493 bp, Homo sapiens; identical to SEQ ID NO: 540127
  misc_feature: HIJSMM301AI4AG.10.17.B06.1.454.light.4.raw

SEQ ID NO: 573477 - DNA, 447 bp, Homo sapiens; identical to SEQ ID NO: 535020
  misc_feature: HIJSMM301DTKO4.18.9.A09.1.454.light.4.raw

SEQ ID NO: 573478 - DNA, 493 bp, Homo sapiens; identical to SEQ ID NO: 540127
  misc_feature: HIJSMM301EJHDB.10.17.B06.1.454.light.4.raw

SEQ ID NO: 573479 - DNA, 477 bp, Homo sapiens
  misc_feature: HIJSMM301EL12Y.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagatttctaattaccctcggacgttcggccagggaccaaagtggatgtcaaccgaactgtggctgcaccta

SEQ ID NO: 573480 - DNA, 485 bp, Homo sapiens; identical to SEQ ID NO: 542261
  misc_feature: HIJSMM301BOVZF.26.78.H01.1.454.light.4.raw

SEQ ID NO: 573481 - DNA, 504 bp, Homo sapiens; identical to SEQ ID NO: 549053
  misc_feature: HIJSMM301BMLDL.4.71.G05.1.454.light.4.raw

SEQ ID NO: 573482 - DNA, 443 bp, Homo sapiens
  misc_feature: HIJSMM301CR74C.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctcgccccctcggtcactctgttcccgccctcctcgtatcctctcg

SEQ ID NO: 573483 - DNA, 490 bp, Homo sapiens
  misc_feature: HIJSMM301CUX48.17.25.C03.1.454.light.4.raw
cgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgtt

SEQ ID NO: 573484 - DNA, 507 bp, Homo sapiens
  misc_feature: HIJSMM301DZLKZ.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagatttgcaacttactactgtcaacagacttacaatataccgaggacgttcggtcgaaggaccaaggtggagatacaaacgaactagtggctgcaccatctgtcttcatcttcccgccact

SEQ ID NO: 573485 - DNA, 504 bp, Homo sapiens; identical to SEQ ID NO: 568334
  misc_feature: HIJSMM301A1QW8.12.48.E04.1.454.light.4.raw

SEQ ID NO: 573486 - DNA, 500 bp, Homo sapiens
  misc_feature: HIJSMM301EEH2W.43.34.D01.1.454.light.4.raw
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgtctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccca

SEQ ID NO: 573487 - DNA, 454 bp, Homo sapiens; identical to SEQ ID NO: 535005
  misc_feature: HIJSMM301B9LWO.19.86.H09.1.454.light.4.raw

SEQ ID NO: 573488 - DNA, 491 bp, Homo sapiens
  misc_feature: HIJSMM301C4YEH.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttcctgaccatctccgggctccacgctgaggacgaggctcattattactgcagctcatatacacccaggggcactctcgtgatattcggcggagggacctggctgaccgtcctacgtcagcccaa

SEQ ID NO: 573489 - DNA, 486 bp, Homo sapiens; identical to SEQ ID NO: 535043
  misc_feature: HIJSMM301C5SAL.46.35.D02.1.454.light.4.raw

SEQ ID NO: 573490 - DNA, 513 bp, Homo sapiens
  misc_feature: HIJSMM301BHDLF.43.9.A09.1.454.light.4.raw
tgtgagtagtcacgaccggtgctcgatttagcgagacgcgcaggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctcttgggggcaaagctgccctgaccctttcggtgcgcagcctgaggatgaggctgactattactgcttgctcgcctatgatgctgctcgggttttcggcggagggaccaagttgaccgtcctaggtcagcccaaggctgccccctcggtcactctcgttcccaccctcctcactact

SEQ ID NO: 573491 - DNA, 497 bp, Homo sapiens
  misc_feature: HIJSMM301EF4Q4.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggtccgaacgggacgacgactaggaggattaaacgaaactgtggctgcaccatctgtcttcat

SEQ ID NO: 573492 - DNA, 488 bp, Homo sapiens
  misc_feature: HIJSMM301A96ID.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccagggaccgacggtcggagtgtcaagcgaactgtggctgcacca

SEQ ID NO: 573493 - DNA, 484 bp, Homo sapiens; identical to SEQ ID NO: 535400
  misc_feature: HIJSMM301BC53H.46.26.C04.1.454.light.4.raw

SEQ ID NO: 573494 - DNA, 485 bp, Homo sapiens; identical to SEQ ID NO: 544818
  misc_feature: HIJSMM301AR1CU.13.36.D03.1.454.light.4.raw

SEQ ID NO: 573495 - DNA, 524 bp, Homo sapiens
  misc_feature: HIJSMM301CLBHM.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtctgcccaaggcccaaccccactgtcactctcgttcccgccctcctccgtcg

SEQ ID NO: 573496 - DNA, 490 bp, Homo sapiens; identical to SEQ ID NO: 534991
  misc_feature: HIJSMM301D3W0B.48.75.G09.1.454.light.4.raw

SEQ ID NO: 573497 - DNA, 503 bp, Homo sapiens
  misc_feature: HIJSMM301BTZI9.48.26.C04.1.454.light.4.raw
agtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaagggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctggt

SEQ ID NO: 573498 - DNA, 490 bp, Homo sapiens
  misc_feature: HIJSMM301ESLGQ.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaaactcatgatttatgaggtcacaaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcccgac

SEQ ID NO: 573499 - DNA, 476 bp, Homo sapiens; identical to SEQ ID NO: 538611
  misc_feature: HIJSMM301DP7H4.7.81.H04.1.454.light.4.raw

SEQ ID NO: 573500 - DNA, 485 bp, Homo sapiens; identical to SEQ ID NO: 539315
  misc_feature: HIJSMM301ADEG8.3.88.H11.1.454.light.4.raw

SEQ ID NO: 573501 - DNA, 493 bp, Homo sapiens; identical to SEQ ID NO: 541489
  misc_feature: HIJSMM301CHBJL.12.23.C01.1.454.light.4.raw

SEQ ID NO: 573502 - DNA, 489 bp, Homo sapiens
  misc_feature: HIJSMM301BIEBV.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggccaagggaccaaggtggaaatcaaacgaactagtggctgcaccatctgtctt

SEQ ID NO: 573503 - DNA, 487 bp, Homo sapiens; identical to SEQ ID NO: 536206
  misc_feature: HIJSMM301ER4J0.47.38.D05.1.454.light.4.raw

SEQ ID NO: 573504 - DNA, 494 bp, Homo sapiens; identical to SEQ ID NO: 534992
  misc_feature: HIJSMM301C2LKC.9.1.A01.1.454.light.4.raw

SEQ ID NO: 573505 - DNA, 506 bp, Homo sapiens
  misc_feature: HIJSMM301CZRRE.4.10.A10.1.454.light.4.raw
agcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctcggtcactctgttccca

SEQ ID NO: 573506 - DNA, 504 bp, Homo sapiens; identical to SEQ ID NO: 549053
  misc_feature: HIJSMM301D23ZY.4.71.G05.1.454.light.4.raw

SEQ ID NO: 573507 - DNA, 518 bp, Homo sapiens
  misc_feature: HIJSMM301EIC56.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctgccccctcggtcactctgttccaccct

SEQ ID NO: 573508 - DNA, 500 bp, Homo sapiens; identical to SEQ ID NO: 539362
  misc_feature: HIJSMM301D0V26.26.26.C04.1.454.light.4.raw

SEQ ID NO: 573509 - DNA, 491 bp, Homo sapiens; identical to SEQ ID NO: 535294
  misc_feature: HIJSMM301CNJFB.16.68.G02.1.454.light.4.raw

SEQ ID NO: 573510 - DNA, 501 bp, Homo sapiens; identical to SEQ ID NO: 536867
  misc_feature: HIJSMM301BJLEV.5.86.H09.1.454.light.4.raw

SEQ ID NO: 573511 - DNA, 466 bp, Homo sapiens
  misc_feature: HIJSMM301AMSIO.12.39.D06.1.454.light.4.raw
  modified_base (431)..(431): a, c, t, g, unknown or other
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactgaaaaacngaccgggtggagagtgaccatgttggaacttatta

SEQ ID NO: 573512 - DNA, 490 bp, Homo sapiens; identical to SEQ ID NO: 535526
  misc_feature: HIJSMM301EHZTY.26.78.H01.1.454.light.4.raw

SEQ ID NO: 573513 - DNA, 497 bp, Homo sapiens; identical to SEQ ID NO: 535286
  misc_feature: HIJSMM301CH4RC.18.59.F04.1.454.light.4.raw

SEQ ID NO: 573514 - DNA, 490 bp, Homo sapiens; identical to SEQ ID NO: 549782
  misc_feature: HIJSMM301EK0FV.49.80.H03.1.454.light.4.raw

SEQ ID NO: 573515 - DNA, 489 bp, Homo sapiens
  misc_feature: HIJSMM301EORE5.16.53.E09.1.454.light.4.raw
tgtactactccacgaccggtgctcgatttagagagagtgtgttgggtttggggactgatcaggactcctcagttcaccttctcacaatgaggctccctgctcagctcctggggctgctaatgctctgggtctctggatccagtgggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgt

SEQ ID NO: 573516 - DNA, 494 bp, Homo sapiens; identical to SEQ ID NO: 534992
  misc_feature: HIJSMM301ESKAP.9.1.A01.1.454.light.4.raw

SEQ ID NO: 573517 - DNA, 486 bp, Homo sapiens; identical to SEQ ID NO: 564416
  misc_feature: HIJSMM301CY19F.14.55.E11.1.454.light.4.raw

SEQ ID NO: 573518 - DNA, 478 bp, Homo sapiens; identical to SEQ ID NO: 535129
  misc_feature: HIJSMM301BNVZK.11.11.A11.1.454.light.4.raw

SEQ ID NO: 573519 - DNA, 510 bp, Homo sapiens
  misc_feature: HIJSMM301BVZ5N.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctgttccccg

SEQ ID NO: 573520 - DNA, 499 bp, Homo sapiens; identical to SEQ ID NO: 536875
  misc_feature: HIJSMM301DHU0G.51.26.C04.1.454.light.4.raw

SEQ ID NO: 573521 - DNA, 487 bp, Homo sapiens
  misc_feature: HIJSMM301BOYRG.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctgaagatcaaacgaa

SEQ ID NO: 573522 - DNA, 389 bp, Homo sapiens; identical to SEQ ID NO: 561342
  misc_feature: HIJSMM301AKCWU.12.6.A06.1.454.light.4.raw

SEQ ID NO: 573523 - DNA, 485 bp, Homo sapiens; identical to SEQ ID NO: 539315
  misc_feature: HIJSMM301ET9QR.3.88.H11.1.454.light.4.raw

SEQ ID NO: 573524 - DNA, 475 bp, Homo sapiens; identical to SEQ ID NO: 570120
  misc_feature: HIJSMM301ARTC6.51.35.D02.1.454.light.4.raw

SEQ ID NO: 573525 - DNA, 499 bp, Homo sapiens; identical to SEQ ID NO: 545133
  misc_feature: HIJSMM301A5FOA.48.83.H06.1.454.light.4.raw

SEQ ID NO: 573526 - DNA, 511 bp, Homo sapiens
  misc_feature: HIJSMM301E0HMO.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcact

SEQ ID NO: 573527 - DNA, 498 bp, Homo sapiens
  misc_feature: HIJSMM301B2YDD.40.42.D09.1.454.light.4.raw
tctagcgactcacgaccggtgctcgatttagacacatacgcagggaaagggggtgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtgggcccaggtggaggatgaagctgactactactgttactcagtggacagcagtggaaatcatggggtattcggcggagggaccaagctgaccgtcctaggtcagccaaggctgccccctcggtcact

SEQ ID NO: 573528 - DNA, 502 bp, Homo sapiens
  misc_feature: HIJSMM301BWI1W.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagacccg

SEQ ID NO: 573529 - DNA, 486 bp, Homo sapiens; identical to SEQ ID NO: 535043
  misc_feature: HIJSMM301B9YBD.46.35.D02.1.454.light.4.raw

SEQ ID NO: 573530 - DNA, 487 bp, Homo sapiens
  misc_feature: HIJSMM301AJP8J.3.10.A10.1.454.light.4.raw
agacgcactccacgaccggtgctcgatttagcgtcgatctcaaggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccca

SEQ ID NO: 573531 - DNA, 510 bp, Homo sapiens
  misc_feature: HIJSMM301CG6ET.5.58.F03.1.454.light.4.raw
  modified_base (415)..(415): a, c, t, g, unknown or other
  modified_base (498)..(498): a, c, t, g, unknown or other
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttacngctgctcatatgcaggtgatcacacttttatgttcgggactgggaccaaggtcaccgtcctaggtcagcccaaggccaacccnctgtcactctcg

SEQ ID NO: 573532 - DNA, 444 bp, Homo sapiens
  misc_feature: HIJSMM301B2YD2.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctggtcactctgttccccgccctcctcgtactagacg

SEQ ID NO: 573533 - DNA, 516 bp, Homo sapiens; identical to SEQ ID NO: 551269
  misc_feature: HIJSMM301AVVX1.47.53.E09.1.454.light.4.raw

SEQ ID NO: 573534 - DNA, 489 bp, Homo sapiens; identical to SEQ ID NO: 535139
  misc_feature: HIJSMM301BU4OC.14.55.E11.1.454.light.4.raw

SEQ ID NO: 573535 - DNA, 505 bp, Homo sapiens
  misc_feature: HIJSMM301BNOIG.10.71.G05.1.454.light.4.raw
catagtagtgcacgaccggtgctcgatttagtgtcgtcgcaagagagagggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctactgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaaactgtggctgcaccatctgtcttcatt

SEQ ID NO: 573536 - DNA, 487 bp, Homo sapiens
  misc_feature: HIJSMM301DBOYZ.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcaca

SEQ ID NO: 573537 - DNA, 465 bp, Homo sapiens
  misc_feature: HIJSMM301AOA4T.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccgccctcctcctacgtctacg

SEQ ID NO: 573538 - DNA, 498 bp, Homo sapiens
  misc_feature: HIJSMM301CUFKZ.43.69.G03.1.454.light.4.raw
tgtgagtagtcacgaccggtgctcgatttagtcgctgcgtaaaggagaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaaggctgaccgtcctaggtcagcccaaggctgcccctcggtcact

SEQ ID NO: 573539 - DNA, 510 bp, Homo sapiens
  misc_feature: HIJSMM301B0R3E.47.85.H08.1.454.light.4.raw
  modified_base (417)..(417): a, c, t, g, unknown or other
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgagggacgaggctgattacttctgttnctcttgggcaactactgtcgtttgggtgttcggcggaggaccaagttgaccgtcctaggtcagcccaaggctgccccctcggtcactctcgtt

SEQ ID NO: 573540 - DNA, 521 bp, Homo sapiens; identical to SEQ ID NO: 538715
  misc_feature: HIJSMM301C8GU3.27.23.C01.1.454.light.4.raw

SEQ ID NO: 573541 - DNA, 504 bp, Homo sapiens
  misc_feature: HIJSMM301DRA05.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgtccgaaggaccaaggtaggaagtacaaacgaactagtggctgcaccatctgtcttcatcttccccg

SEQ ID NO: 573542 - DNA, 503 bp, Homo sapiens; identical to SEQ ID NO: 538884
  misc_feature: HIJSMM301DS7O7.27.78.H01.1.454.light.4.raw

SEQ ID NO: 573543 - DNA, 504 bp, Homo sapiens
  misc_feature: HIJSMM301B5AEM.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccgccctcctctacgtcgtat

SEQ ID NO: 573544 - DNA, 478 bp, Homo sapiens
  misc_feature: HIJSMM301DPUW5.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactccatgacaacagcctgagtatttggctgttcggcggcgggacc

SEQ ID NO: 573545 - DNA, 494 bp, Homo sapiens; identical to SEQ ID NO: 535680
  misc_feature: HIJSMM301DQNBY.16.78.H01.1.454.light.4.raw

SEQ ID NO: 573546 - DNA, 503 bp, Homo sapiens; identical to SEQ ID NO: 536618
  misc_feature: HIJSMM301DD9K9.10.82.H05.1.454.light.4.raw

SEQ ID NO: 573547 - DNA, 509 bp, Homo sapiens
  misc_feature: HIJSMM301B0O47.5.24.C02.1.454.light.4.raw
atcagacacgcacgaccggtgctcgatttagtacagatcgttaggggaaagggggggtcgtcaggaggcagcgctctcaggacgtcaccaccatggcctgggctctgctcctcctcaccctcctcactcagggcacagggtccgtgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgccccccg

SEQ ID NO: 573548 - DNA, 520 bp, Homo sapiens
  misc_feature: HIJSMM301AS2XE.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcctgccccctcggtcactctcgttcccgccctcctccacg

SEQ ID NO: 573549 - DNA, 512 bp, Homo sapiens
  misc_feature: HIJSMM301CXOBR.51.25.C03.1.454.light.4.raw
cgatcgtatacacgaccggtgctcgatttagtagtgtagatttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagctagaggccaggccaatctccaagacgcctaatttataaggtttctaaccgggactctggggtcccagacagattcagcggcagtgggtcaggcactgatttcacactgataatcgacagggtggaggctgaggatgttgggtttattactgcatgcaaggtacacactggcctgggacgttcggccaagggaccaaggtggaaatcaaacgaactagtggctgcaccatctgtcttcta

SEQ ID NO: 573550 - DNA, 512 bp, Homo sapiens
  misc_feature: HIJSMM301BMQQX.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcggaccaaaattagagatcaaacgaactagtggctgcaccatctgtcttctactcttcccgtccact

SEQ ID NO: 573551 - DNA, 494 bp, Homo sapiens; identical to SEQ ID NO: 534994
  misc_feature: HIJSMM301CI93R.27.78.H01.1.454.light.4.raw

SEQ ID NO: 573552 - DNA, 482 bp, Homo sapiens; identical to SEQ ID NO: 540521
  misc_feature: HIJSMM301ASCI7.21.25.C03.1.454.light.4.raw

SEQ ID NO: 573553 - DNA, 492 bp, Homo sapiens
  misc_feature: HIJSMM301BMF2G.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgtaacctgaagattttgcaacttactactgtcaacagagttacagtacccccctcactttcggcggagggaccaaggcggagatcagacgaactgtggctgcaccatctgtcttcattcc

SEQ ID NO: 573554 - DNA, 511 bp, Homo sapiens
  misc_feature: HIJSMM301C7BTB.4.78.H01.1.454.light.4.raw
agcactgtagcacgaccggtgctcgatttagtgtgagtagtttgggtttggggtgatcaggactcctcagttcaccttctcacaatgaggctccctgctcagctcctggggctgctaatgctctgggtcccaggatccagtggggatgtcttttattcaggatccagtggggatgttgtgttgactcagtctccactctccctgcccgtcacccttggacagccggcctccatctcctgcaggtctagtcaaagcctcgaacacagtaccggaaacaccttcttgagttggtatcaccagaggccaggccaatctccaaggcgcctactttataaggtttctaaccgggactctggggtcccagacagattcagcggcagtgggtcaggcactgatttcacactgagaatcagcagggtggaaactgaggatgttgggatttattactgcttgcaaggttcacactggccttggacgttcggcccagggaccaaggtggaaatcaaacgaa

SEQ ID NO: 573555 - DNA, 484 bp, Homo sapiens; identical to SEQ ID NO: 535240
  misc_feature: HIJSMM301BHFMC.47.60.F05.1.454.light.4.raw

SEQ ID NO: 573556 - DNA, 501 bp, Homo sapiens
  misc_feature: HIJSMM301DPQNF.48.41.D08.1.454.light.4.raw
agtatacatacacgaccggtgctcgatttagtcacgcgagaaagggaaaggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttca

SEQ ID NO: 573557 - DNA, 454 bp, Homo sapiens; identical to SEQ ID NO: 534964
  misc_feature: HIJSMM301EA5E3.19.86.H09.1.454.light.4.raw

SEQ ID NO: 573558 - DNA, 507 bp, Homo sapiens
  misc_feature: HIJSMM301DFFLE.8.42.D09.1.454.light.4.raw
ctcgcgtgtccacgaccggtgctcgatttagacacatacgcagggaaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagccaaggctgccccctcggtcactctgttcccaccct

SEQ ID NO: 573559 - DNA, 501 bp, Homo sapiens
  misc_feature: HIJSMM301D8K1U.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggccaaactgaccgtcctaggtcagcccaa

SEQ ID NO: 573560 - DNA, 485 bp, Homo sapiens; identical to SEQ ID NO: 534977
  misc_feature: HIJSMM301EHVOH.15.28.C06.1.454.light.4.raw

SEQ ID NO: 573561 - DNA, 494 bp, Homo sapiens; identical to SEQ ID NO: 535629
  misc_feature: HIJSMM301A1WGM.4.27.C05.1.454.light.4.raw

SEQ ID NO: 573562 - DNA, 488 bp, Homo sapiens
  misc_feature: HIJSMM301CJGRR.48.37.D04.1.454.light.4.raw
agtatacatacacgaccggtgctcgatttagtagcatactgttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgca

SEQ ID NO: 573563 - DNA, 493 bp, Homo sapiens
  misc_feature: HIJSMM301CH0Q1.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtctaacaggctaacactttccccctcactttcggtcggagggaccaaggtggagatcaagcgaactgtggctgcaccatctgtctt

SEQ ID NO: 573564 - DNA, 493 bp, Homo sapiens
  misc_feature: HIJSMM301EXKG5.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacggtcaaacgaactgtggctgcaccatctgtcttcatt

SEQ ID NO: 573565 - DNA, 498 bp, Homo sapiens
  misc_feature: HIJSMM301BQJ7F.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcacgtcctaggtcagcccaaggccaaccca

SEQ ID NO: 573566 - DNA, 485 bp, Homo sapiens; identical to SEQ ID NO: 535653
  misc_feature: HIJSMM301EI6O0.47.62.F07.1.454.light.4.raw

SEQ ID NO: 573567 - DNA, 507 bp, Homo sapiens
  misc_feature: HIJSMM301AOHMU.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatccggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaacccactgtca

SEQ ID NO: 573568 - DNA, 513 bp, Homo sapiens; identical to SEQ ID NO: 539258
  misc_feature: HIJSMM301ECP99.43.19.B08.1.454.light.4.raw

SEQ ID NO: 573569 - DNA, 502 bp, Homo sapiens
  misc_feature: HIJSMM301AOW2S.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctcctgaccgtctctgggctccaggctgaggatgaggctgattattattgcagctcatatgcaggcagttacaatgtgatattcggcggagggaccaaaactgaccgtcctaggtcagcccaaggctgccccctc

SEQ ID NO: 573570 - DNA, 494 bp, Homo sapiens; identical to SEQ ID NO: 534994
  misc_feature: HIJSMM301C4O76.27.78.H01.1.454.light.4.raw

SEQ ID NO: 573571 - DNA, 490 bp, Homo sapiens
  misc_feature: HIJSMM301E0AM0.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgaccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacaggtggggtcccgtcaaggttcagtggcagtggatctgggacagatttcactctcaccgtcagcagtctgcaacctgaagattttgcaacttactactgtcaacagagttacacgtacccccctcactttcggcggagggaccaaggcggagatcagacgaactgtggctgcaccatctgtcttcta

SEQ ID NO: 573572 - DNA, 502 bp, Homo sapiens; identical to SEQ ID NO: 537816
  misc_feature: HIJSMM301B67OB.19.78.H01.1.454.light.4.raw

SEQ ID NO: 573573 - DNA, 506 bp, Homo sapiens
  misc_feature: HIJSMM301ECWO7.49.65.F10.1.454.light.4.raw
agtcgagagacacgaccggtgctcgatttagctacgctctaagggcacgaccggtgctcgatttagctacgctctaaggggctgggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgtcacgtgtgggacagtagtagtgatcatgtggtgttcggcggagggaccaagctgaccgtcctaggtcacg

SEQ ID NO: 573574 - DNA, 497 bp, Homo sapiens
  misc_feature: HIJSMM301CVHX4.13.38.D05.1.454.light.4.raw
  modified_base (433)..(433): a, c, t, g, unknown or other
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatnttatagtactcctccgaggctcactttcggcggagggaccaaggtggagatcaaacgaactgtc

SEQ ID NO: 573575 - DNA, 498 bp, Homo sapiens; identical to SEQ ID NO: 547944
  misc_feature: HIJSMM301CKXSW.41.53.E09.1.454.light.4.raw

SEQ ID NO: 573576 - DNA, 501 bp, Homo sapiens; identical to SEQ ID NO: 561252
  misc_feature: HIJSMM301DMAK7.47.66.F11.1.454.light.4.raw

SEQ ID NO: 573577 - DNA, 515 bp, Homo sapiens
  misc_feature: HIJSMM301EUSER.51.24.C02.1.454.light.4.raw
cgatcgtatacacgaccggtgctcgatttagtacagatcgttagggaaaggggtgatcaggactcctcagttcaccttctcacaatgaggctccctgctcagctcctggggctgctaatgctctgggtcccagcatccagtggagatgttgtgctgactcagtctccactctccctgtccgtcacccttggacagccagcttccatctcctgcaggtctagtcaaagcctcgtttatagtgttggaaacacctacttgaattggtttcagcagaggccaggccaatctccaagacgcctaatttataaggtttctaaccgggactctggggtcccagacagattcagcggcagtgggtcaggcactgatttcacactgataatcgacaggggtggaggctgaggatgttgggttttattactgcatgcaaggtacacactggcctgggacgttcggtccaagggaccgaaaggtaggaaatacaaacgaacctagtggctgcaccatctgtcttt

SEQ ID NO: 573578 - DNA, 484 bp, Homo sapiens
  misc_feature: HIJSMM301DWYW6.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcacc

SEQ ID NO: 573579 - DNA, 489 bp, Homo sapiens; identical to SEQ ID NO: 535386
  misc_feature: HIJSMM301C95SK.12.51.E07.1.454.light.4.raw

SEQ ID NO: 573580 - DNA, 486 bp, Homo sapiens; identical to SEQ ID NO: 552610
  misc_feature: HIJSMM301DB7F4.8.49.E05.1.454.light.4.raw

SEQ ID NO: 573581 - DNA, 487 bp, Homo sapiens; identical to SEQ ID NO: 536206
  misc_feature: HIJSMM301BFKSC.47.38.D05.1.454.light.4.raw

SEQ ID NO: 573582 - DNA, 505 bp, Homo sapiens; identical to SEQ ID NO: 535987
  misc_feature: HIJSMM301EDD7D.18.37.D04.1.454.light.4.raw

SEQ ID NO: 573583 - DNA, 501 bp, Homo sapiens; identical to SEQ ID NO: 536818
  misc_feature: HIJSMM301C1FHW.12.82.H05.1.454.light.4.raw

SEQ ID NO: 573584 - DNA, 501 bp, Homo sapiens
  misc_feature: HIJSMM301DN6OW.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgctagtttattactgtcagcagcggggcaattggccgctcactttcggcgggggaccaaggtggagttcaaacgaactgtggctgcaccatctgtcttcatcttccg

SEQ ID NO: 573585 - DNA, 485 bp, Homo sapiens; identical to SEQ ID NO: 535985
  misc_feature: HIJSMM301AP2DD.15.1.A01.1.454.light.4.raw

SEQ ID NO: 573586 - DNA, 481 bp, Homo sapiens; identical to SEQ ID NO: 535993
  misc_feature: HIJSMM301BCZJZ.21.25.C03.1.454.light.4.raw

SEQ ID NO: 573587 - DNA, 492 bp, Homo sapiens; identical to SEQ ID NO: 567797
  misc_feature: HIJSMM301BG9KV.41.72.G06.1.454.light.4.raw

SEQ ID NO: 573588 - DNA, 486 bp, Homo sapiens; identical to SEQ ID NO: 535523
  misc_feature: HIJSMM301EL4AV.22.73.G07.1.454.light.4.raw

SEQ ID NO: 573589 - DNA, 500 bp, Homo sapiens; identical to SEQ ID NO: 565733
  misc_feature: HIJSMM301D0C0P.14.57.F02.1.454.light.4.raw

SEQ ID NO: 573590 - DNA, 513 bp, Homo sapiens; identical to SEQ ID NO: 565434
  misc_feature: HIJSMM301CF5C5.16.1.A01.1.454.light.4.raw

SEQ ID NO: 573591 - DNA, 486 bp, Homo sapiens; identical to SEQ ID NO: 535043
  misc_feature: HIJSMM301EXCBY.46.35.D02.1.454.light.4.raw

SEQ ID NO: 573592 - DNA, 480 bp, Homo sapiens; identical to SEQ ID NO: 556377
  misc_feature: HIJSMM301EXWSZ.40.59.F04.1.454.light.4.raw

SEQ ID NO: 573593 - DNA, 502 bp, Homo sapiens; identical to SEQ ID NO: 541971
  misc_feature: HIJSMM301A79NG.4.39.D06.1.454.light.4.raw

SEQ ID NO: 573594 - DNA, 486 bp, Homo sapiens; identical to SEQ ID NO: 535043
  misc_feature: HIJSMM301D3AMQ.46.35.D02.1.454.light.4.raw

SEQ ID NO: 573595 - DNA, 498 bp, Homo sapiens
  misc_feature: HIJSMM301BMCQG.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtccagcaatattatattcctcctcagacgttcggccaagggaccaaggtggaaatcaaacgaactgtggctgcacca

SEQ ID NO: 573596 - DNA, 507 bp, Homo sapiens; identical to SEQ ID NO: 544755
  misc_feature: HIJSMM301EFZX6.11.57.F02.1.454.light.4.raw

SEQ ID NO: 573597 - DNA, 492 bp, Homo sapiens
  misc_feature: HIJSMM301D9CMF.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaa

SEQ ID NO: 573598 - DNA, 495 bp, Homo sapiens; identical to SEQ ID NO: 535486
  misc_feature: HIJSMM301EBZQI.26.72.G06.1.454.light.4.raw

SEQ ID NO: 573599 - DNA, 492 bp, Homo sapiens; identical to SEQ ID NO: 567797
  misc_feature: HIJSMM301DV48E.41.72.G06.1.454.light.4.raw

SEQ ID NO: 573600 - DNA, 494 bp, Homo sapiens; identical to SEQ ID NO: 534992
  misc_feature: HIJSMM301ET2N6.9.1.A01.1.454.light.4.raw

SEQ ID NO: 573601 - DNA, 498 bp, Homo sapiens
  misc_feature: HIJSMM301AD0HI.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggagtatacagacgaactagtggctg

SEQ ID NO: 573602 - DNA, 492 bp, Homo sapiens
  misc_feature: HIJSMM301BI259.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctagaaaatcagtagggtggaggctgaggatgttggggtttattactgcatgcaagttctacaaacttcctacacttttggccgaggggaccaagctggagatcaaacgaactgtgg

SEQ ID NO: 573603 - DNA, 484 bp, Homo sapiens; identical to SEQ ID NO: 535400
  misc_feature: HIJSMM301C19YL.46.26.C04.1.454.light.4.raw

SEQ ID NO: 573604 - DNA, 493 bp, Homo sapiens
  misc_feature: HIJSMM301BM9A9.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcacatct

SEQ ID NO: 573605 - DNA, 483 bp, Homo sapiens; identical to SEQ ID NO: 541990
  misc_feature: HIJSMM301DXVJK.46.26.C04.1.454.light.4.raw

SEQ ID NO: 573606 - DNA, 499 bp, Homo sapiens; identical to SEQ ID NO: 535899
  misc_feature: HIJSMM301BO9DJ.19.78.H01.1.454.light.4.raw

SEQ ID NO: 573607 - DNA, 497 bp, Homo sapiens
  misc_feature: HIJSMM301CGDU8.43.61.F06.1.454.light.4.raw
tgtgagtagtcacgaccggtgctcgatttagctacgctctaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtacccccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaactagtggctgcaccatctgtctt

SEQ ID NO: 573608 - DNA, 505 bp, Homo sapiens; identical to SEQ ID NO: 536117
  misc_feature: HIJSMM301DBA0O.8.71.G05.1.454.light.4.raw

SEQ ID NO: 573609 - DNA, 445 bp, Homo sapiens; identical to SEQ ID NO: 569578
  misc_feature: HIJSMM301DIF3F.8.73.G07.1.454.light.4.raw

SEQ ID NO: 573610 - DNA, 492 bp, Homo sapiens
  misc_feature: HIJSMM301CUR6I.18.11.A11.1.454.light.4.raw
tacgagtatgcacgaccggtgctcgatttagctacgactgcaggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtattttaaagaactccaacaatcagaattacttaacttggtatcagcagaaagcaggccagcctcccaagttgctcatttactgggcatcaacccgggaatccggggtccctgaccgattcagtggcagcgggtctgggacagacttcactctcaccatcagcagcctgcaggctgaagatgtggcagtttattactgtcagcagtattatagtactcctccgacgttcggccaagggaccaaggtggagattaaacgaactgtggctgcaccatctgtcttcatcttcccgccat

SEQ ID NO: 573611 - DNA, 498 bp, Homo sapiens; identical to SEQ ID NO: 547944
  misc_feature: HIJSMM301AY2ZK.41.53.E09.1.454.light.4.raw

SEQ ID NO: 573612 - DNA, 505 bp, Homo sapiens; identical to SEQ ID NO: 560404
  misc_feature: HIJSMM301CQI24.9.12.B01.1.454.light.4.raw

SEQ ID NO: 573613 - DNA, 489 bp, Homo sapiens; identical to SEQ ID NO: 557621
  misc_feature: HIJSMM301AMFS4.13.87.H10.1.454.light.4.raw

SEQ ID NO: 573614 - DNA, 506 bp, Homo sapiens
  misc_feature: HIJSMM301AC8A8.19.78.H01.1.454.light.4.raw
tactctcgtgcacgaccggtgctcgatttagtgtgagtagtttgggtttggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcta

SEQ ID NO: 573615 - DNA, 504 bp, Homo sapiens
  misc_feature: HIJSMM301DRUBM.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggcccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctggtcactc

SEQ ID NO: 573616 - DNA, 503 bp, Homo sapiens
  misc_feature: HIJSMM301AWVT8.4.71.G05.1.454.light.4.raw
  modified_base (237)..(237): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagccaaggctgccccctcggtccactctgtt

SEQ ID NO: 573617 - DNA, 509 bp, Homo sapiens
  misc_feature: HIJSMM301BH4TX.26.72.G06.1.454.light.4.raw
  modified_base (479)..(479): a, c, t, g, unknown or other
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagactgatattaacagcgaaaanagattttgttaagggaagtaatgaagttaa

SEQ ID NO: 573618 - DNA, 487 bp, Homo sapiens; identical to SEQ ID NO: 537573
  misc_feature: HIJSMM301ADHLQ.3.10.A10.1.454.light.4.raw

SEQ ID NO: 573619 - DNA, 494 bp, Homo sapiens; identical to SEQ ID NO: 535276
  misc_feature: HIJSMM301DRHE8.16.6.A06.1.454.light.4.raw

SEQ ID NO: 573620 - DNA, 491 bp, Homo sapiens
  misc_feature: HIJSMM301BHJJ5.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtcagggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccacctcctcacg

SEQ ID NO: 573621 - DNA, 458 bp, Homo sapiens; identical to SEQ ID NO: 543829
  misc_feature: HIJSMM301CM4FV.51.47.E03.1.454.light.4.raw

SEQ ID NO: 573622 - DNA, 505 bp, Homo sapiens; identical to SEQ ID NO: 535503
  misc_feature: HIJSMM301EF84B.8.28.C06.1.454.light.4.raw

SEQ ID NO: 573623 - DNA, 494 bp, Homo sapiens
  misc_feature: HIJSMM301BU7P2.27.78.H01.1.454.light.4.raw
  modified_base (483)..(483): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaacgaactgtggctgacnccatctgtctt

SEQ ID NO: 573624 - DNA, 492 bp, Homo sapiens
  misc_feature: HIJSMM301D5XPP.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggaggaccagggtggagatacaaacgaactgtggctgcacatctgtcttcta

SEQ ID NO: 573625 - DNA, 447 bp, Homo sapiens
  misc_feature: HIJSMM301D2DQP.18.9.A09.1.454.light.4.raw
tacgagtatgcacgaccggtgctcgatttagcgagacgcgcagggtcctgggcccagtctgtgctgacgcagccgccctcagtgtatggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 573626 - DNA, 493 bp, Homo sapiens
  misc_feature: HIJSMM301BQZ0K.40.50.E06.1.454.light.4.raw
tctagcgactcacgaccggtgctcgatttagatctactgacaacacacaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggagacaccggtgatattgggacttataaccttgtctcttggtaccaacagcacccaggcaaagcccccaaacttatgatttatgagggcagccagcggccctcatggatttctagtcgcttctctgcctccaagtctggcaacacggcctccctgacaatctctggactccaggctgaggacgaggctgagtattactgctgcgcatttgcaggtagtagcgcccccttatgtcttcgggactgggaccaaggtcacagtcctaggtcagcccaagg

SEQ ID NO: 573627 - DNA, 498 bp, Homo sapiens; identical to SEQ ID NO: 535295
  misc_feature: HIJSMM301BQNFU.15.25.C03.1.454.light.4.raw

SEQ ID NO: 573628 - DNA, 466 bp, Homo sapiens
  misc_feature: HIJSMM301DR9R1.3.20.B09.1.454.light.4.raw
agacgcactccacgaccggtgctcgatttagtgtagtgtgaagggggcaggagtcagtctcagtcaggacacagcatggacatgaggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggaggatcaaacgaa

SEQ ID NO: 573629 - DNA, 497 bp, Homo sapiens; identical to SEQ ID NO: 538296
  misc_feature: HIJSMM301BO2UH.18.11.A11.1.454.light.4.raw

SEQ ID NO: 573630 - DNA, 479 bp, Homo sapiens; identical to SEQ ID NO: 536050
  misc_feature: HIJSMM301DMADC.5.73.G07.1.454.light.4.raw

SEQ ID NO: 573631 - DNA, 495 bp, Homo sapiens
  misc_feature: HIJSMM301A6YKX.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccatctgtt

SEQ ID NO: 573632 - DNA, 500 bp, Homo sapiens; identical to SEQ ID NO: 537851
  misc_feature: HIJSMM301EMMII.52.37.D04.1.454.light.4.raw

SEQ ID NO: 573633 - DNA, 503 bp, Homo sapiens; identical to SEQ ID NO: 540136
  misc_feature: HIJSMM301EQPKI.19.10.A10.1.454.light.4.raw

SEQ ID NO: 573634 - DNA, 516 bp, Homo sapiens; identical to SEQ ID NO: 563083
  misc_feature: HIJSMM301C39KX.5.27.C05.1.454.light.4.raw

SEQ ID NO: 573635 - DNA, 495 bp, Homo sapiens
  misc_feature: HIJSMM301AJNJ1.21.8.A08.1.454.light.4.raw
tcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgactactattgttacgcaccagacagtagtggtcatcagggggtattcggcggagggaccaagttgaccgtccttggtcagcccaaggctgccccctcggtcact

SEQ ID NO: 573636 - DNA, 487 bp, Homo sapiens
  misc_feature: HIJSMM301BGCAE.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcgctctcaccatcagcagactggagcctgaagattttgcagtctattactgtcagcagtatggtcacgtcccaagaacttttggccaggggaccaagctggagatacaaacgaactgtggctgcaccat

SEQ ID NO: 573637 - DNA, 480 bp, Homo sapiens; identical to SEQ ID NO: 535291
  misc_feature: HIJSMM301ETQ52.22.59.F04.1.454.light.4.raw

SEQ ID NO: 573638 - DNA, 491 bp, Homo sapiens
  misc_feature: HIJSMM301BRZRG.48.14.B03.1.454.light.4.raw
agtatacatacacgaccggtgctcgatttagtgtgagtagttccgcggggagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttatta

SEQ ID NO: 573639 - DNA, 496 bp, Homo sapiens
  misc_feature: HIJSMM301BFSXK.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggacaaggtggaatacaacgaactgtggctgcacc

SEQ ID NO: 573640 - DNA, 507 bp, Homo sapiens; identical to SEQ ID NO: 538063
  misc_feature: HIJSMM301BJ0TX.47.85.H08.1.454.light.4.raw

SEQ ID NO: 573641 - DNA, 514 bp, Homo sapiens; identical to SEQ ID NO: 540552
  misc_feature: HIJSMM301CNNTT.16.66.F11.1.454.light.4.raw

SEQ ID NO: 573642 - DNA, 485 bp, Homo sapiens; identical to SEQ ID NO: 559141
  misc_feature: HIJSMM301DB5IR.5.71.G05.1.454.light.4.raw

SEQ ID NO: 573643 - DNA, 508 bp, Homo sapiens; identical to SEQ ID NO: 560800
  misc_feature: HIJSMM301BA35D.17.33.C11.1.454.light.4.raw

SEQ ID NO: 573644 - DNA, 504 bp, Homo sapiens
  misc_feature: HIJSMM301CASA0.48.33.C11.1.454.light.4.raw
agtatacatacacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtctacttcggccctgggaccaaataaatagtcaatcgaactagtggctgcaccatctgtcttcatt

SEQ ID NO: 573645 - DNA, 513 bp, Homo sapiens
  misc_feature: HIJSMM301AEUDY.40.53.E09.1.454.light.4.raw
tctagcgactcacgaccggtgctcgatttagagagagtgtgttgggtttgggggtagctcaggaagcagagcctggagcatctccactatggcctgggctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttccccccaccactttaatctatgaggataacaaaagactctctggggtccctgatcggttctctggctccatcgacagctcctccaattctgcctccctcaccatctctggactgaagactgaggacgaggctgattattactgtcagagttatgatgacaccaattaactgggtgttcggtcggagggaccgaagactgaccgtcctaggtcagcccaacggctgccccctccggtcc

SEQ ID NO: 573646 - DNA, 489 bp, Homo sapiens; identical to SEQ ID NO: 535139
  misc_feature: HIJSMM301CR5BU.14.55.E11.1.454.light.4.raw

SEQ ID NO: 573647 - DNA, 462 bp, Homo sapiens
  misc_feature: HIJSMM301DMUMC.4.39.D06.1.454.light.4.raw
agcactgtagcacgaccggtgctcgatttagtgacatctcgcagttctttggggcttctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttattctgccagcaatataatagttattggacgttcggccaggggaccaaggtcgaaaatgagacgaactgtggctgcaccatctgtcttcatcttcccgccatctgactacagtgct

SEQ ID NO: 573648 - DNA, 454 bp, Homo sapiens; identical to SEQ ID NO: 536449
  misc_feature: HIJSMM301BGN20.18.78.H01.1.454.light.4.raw

SEQ ID NO: 573649 - DNA, 487 bp, Homo sapiens
  misc_feature: HIJSMM301EDA3M.41.28.C06.1.454.light.4.raw
tctatactatcacgaccggtgctcgatttagagctcacgtattgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgccctaggtcacg

SEQ ID NO: 573650 - DNA, 504 bp, Homo sapiens
  misc_feature: HIJSMM301B1RPD.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaaccgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 573651 - DNA, 490 bp, Homo sapiens; identical to SEQ ID NO: 535526
  misc_feature: HIJSMM301A0RRV.26.78.H01.1.454.light.4.raw

SEQ ID NO: 573652 - DNA, 491 bp, Homo sapiens
  misc_feature: HIJSMM301ESW00.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtcccatcaaggttcagcggcagtggatctggcacagatttcactctcaccatcagcagcctgcagcctgaagatttcgcaacttattactgtctacaagattacaattaccctcggacgttcggccaggggaccgaacggtggaaagtacaaacgaactagtggctgcacca

SEQ ID NO: 573653 - DNA, 502 bp, Homo sapiens; identical to SEQ ID NO: 540449
  misc_feature: HIJSMM301EKA9I.10.71.G05.1.454.light.4.raw

SEQ ID NO: 573654 - DNA, 444 bp, Homo sapiens
  misc_feature: HIJSMM301BP12G.5.9.A09.1.454.light.4.raw
  modified_base (426)..(426): a, c, t, g, unknown or other
  modified_base (438)..(438): a, c, t, g, unknown or other
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccncctctcctcgtntctgct

SEQ ID NO: 573655 - DNA, 499 bp, Homo sapiens; identical to SEQ ID NO: 567848
  misc_feature: HIJSMM301C5EW2.53.5.A05.1.454.light.4.raw

SEQ ID NO: 573656 - DNA, 490 bp, Homo sapiens; identical to SEQ ID NO: 537936
  misc_feature: HIJSMM301CE0XW.48.87.H10.1.454.light.4.raw

SEQ ID NO: 573657 - DNA, 507 bp, Homo sapiens
  misc_feature: HIJSMM301A3MGM.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggcctcccaggctcctcatctatggtgcatccaccagggccactggtactcccagccaggttcagtggcaggtgggtctgggacaggagttcactctcaccatcagcagcctgcagtctgaagtattttgtcggtttattactgtcagcagtataataactggcctccacggtactacttttggccgaggggaccaagctggagatacaaacgtaactgtggctgcaccatctgtt

SEQ ID NO: 573658 - DNA, 494 bp, Homo sapiens; identical to SEQ ID NO: 540913
  misc_feature: HIJSMM301BP06G.26.72.G06.1.454.light.4.raw

SEQ ID NO: 573659 - DNA, 507 bp, Homo sapiens; identical to SEQ ID NO: 563344
  misc_feature: HIJSMM301DT2J0.3.79.H02.1.454.light.4.raw

SEQ ID NO: 573660 - DNA, 512 bp, Homo sapiens
  misc_feature: HIJSMM301EWEEK.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggataagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctcct

SEQ ID NO: 573661 - DNA, 441 bp, Homo sapiens; identical to SEQ ID NO: 534971
  misc_feature: HIJSMM301C5K54.11.3.A03.1.454.light.4.raw

SEQ ID NO: 573662 - DNA, 506 bp, Homo sapiens
  misc_feature: HIJSMM301D0GV0.47.85.H08.1.454.light.4.raw
agctcacgtacacgaccggtgctcgatttagtatcactcagtcgcggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactc

SEQ ID NO: 573663 - DNA, 496 bp, Homo sapiens
  misc_feature: HIJSMM301EQPJ0.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggaggttcaaacgaactgtggctgcaccatctgtcttcatt

SEQ ID NO: 573664 - DNA, 512 bp, Homo sapiens
  misc_feature: HIJSMM301CA1L1.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctcgccccctcggtcactctcg

SEQ ID NO: 573665 - DNA, 487 bp, Homo sapiens; identical to SEQ ID NO: 537220
  misc_feature: HIJSMM301BGK13.16.53.E09.1.454.light.4.raw

SEQ ID NO: 573666 - DNA, 505 bp, Homo sapiens
  misc_feature: HIJSMM301BCL4H.3.79.H02.1.454.light.4.raw
agacgcactccacgaccggtgctcgatttagtgtcacacgaagggaaagggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctggt

SEQ ID NO: 573667 - DNA, 502 bp, Homo sapiens; identical to SEQ ID NO: 541971
  misc_feature: HIJSMM301BWLV6.4.39.D06.1.454.light.4.raw

SEQ ID NO: 573668 - DNA, 517 bp, Homo sapiens
  misc_feature: HIJSMM301EFK5Z.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccaccctcctcacta

SEQ ID NO: 573669 - DNA, 490 bp, Homo sapiens
  misc_feature: HIJSMM301CH8GO.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagaccgttcggccaagggaccaaggtggaaatcaaacgaactgtgg

SEQ ID NO: 573670 - DNA, 487 bp, Homo sapiens; identical to SEQ ID NO: 542049
  misc_feature: HIJSMM301BOJIG.19.71.G05.1.454.light.4.raw

SEQ ID NO: 573671 - DNA, 516 bp, Homo sapiens
  misc_feature: HIJSMM301ELGAS.40.27.C05.1.454.light.4.raw
tctagcgactcacgaccggtgctcgatttagacgcgatcgaagggtttggggcagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctcctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactc

SEQ ID NO: 573672 - DNA, 506 bp, Homo sapiens; identical to SEQ ID NO: 549576
  misc_feature: HIJSMM301B2ZVV.7.71.G05.1.454.light.4.raw

SEQ ID NO: 573673 - DNA, 485 bp, Homo sapiens; identical to SEQ ID NO: 535985
  misc_feature: HIJSMM301ECMJ7.15.1.A01.1.454.light.4.raw

SEQ ID NO: 573674 - DNA, 505 bp, Homo sapiens
  misc_feature: HIJSMM301A6TIA.48.70.G04.1.454.light.4.raw
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatcaaacgaaactgtggctgcaccatctgt

SEQ ID NO: 573675 - DNA, 493 bp, Homo sapiens
  misc_feature: HIJSMM301DVEUY.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccgaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccaggggaccaagctagaaatcaaacgaactgtggctgcaccatctgtcttc

SEQ ID NO: 573676 - DNA, 447 bp, Homo sapiens; identical to SEQ ID NO: 535201
  misc_feature: HIJSMM301BFR7J.18.9.A09.1.454.light.4.raw

SEQ ID NO: 573677 - DNA, 513 bp, Homo sapiens; identical to SEQ ID NO: 535719
  misc_feature: HIJSMM301AUOPH.17.33.C11.1.454.light.4.raw

SEQ ID NO: 573678 - DNA, 490 bp, Homo sapiens
  misc_feature: HIJSMM301BYAXN.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaagtggggtgccatcaaggttcagcggcagtggatctgggacagaattcactctcaccatcagcaccctgcagcctgatgattttgcaacttattactgtcaacagtataatagtaattcctggacgttcggccaagggaccaaggtaggaaatacaaacgaactagtggctgcaccatctgtctt

SEQ ID NO: 573679 - DNA, 502 bp, Homo sapiens
  misc_feature: HIJSMM301B4O3W.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatcaacgaactgtggctgcaccatctgtt

SEQ ID NO: 573680 - DNA, 485 bp, Homo sapiens
  misc_feature: HIJSMM301EZ334.26.23.C01.1.454.light.4.raw
  modified_base (478)..(478): a, c, t, g, unknown or other
  modified_base (481)..(481): a, c, t, g, unknown or other
agactatactcacgaccggtgctcgatttagtacacgtgattagggattgggggagtcagacccagtcaggacacagcatggacatgagggtcccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtgctgcncanctgt

SEQ ID NO: 573681 - DNA, 494 bp, Homo sapiens
  misc_feature: HIJSMM301ELJLP.43.34.D01.1.454.light.4.raw
tgtgagtagtcacgaccggtgctcgatttagatcgtctgtgttgggtttgggcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttac

SEQ ID NO: 573682 - DNA, 486 bp, Homo sapiens; identical to SEQ ID NO: 535290
  misc_feature: HIJSMM301BWBT7.3.12.B01.1.454.light.4.raw

SEQ ID NO: 573683 - DNA, 509 bp, Homo sapiens; identical to SEQ ID NO: 535670
  misc_feature: HIJSMM301CS848.47.23.C01.1.454.light.4.raw

SEQ ID NO: 573684 - DNA, 487 bp, Homo sapiens
  misc_feature: HIJSMM301BIBWR.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgctagtttattactgtcagcattacaataactggcctcggctcactttcggcggagggaccaaggtggagatacaaacgaactgtggctgcacat

SEQ ID NO: 573685 - DNA, 489 bp, Homo sapiens; identical to SEQ ID NO: 562659
  misc_feature: HIJSMM301C8KRN.19.57.F02.1.454.light.4.raw

SEQ ID NO: 573686 - DNA, 489 bp, Homo sapiens; identical to SEQ ID NO: 535139
  misc_feature: HIJSMM301EJMFH.14.55.E11.1.454.light.4.raw

SEQ ID NO: 573687 - DNA, 487 bp, Homo sapiens; identical to SEQ ID NO: 539157
  misc_feature: HIJSMM301CWTCE.26.37.D04.1.454.light.4.raw

SEQ ID NO: 573688 - DNA, 497 bp, Homo sapiens; identical to SEQ ID NO: 536807
  misc_feature: HIJSMM301DBL2S.10.37.D04.1.454.light.4.raw

SEQ ID NO: 573689 - DNA, 483 bp, Homo sapiens; identical to SEQ ID NO: 562592
  misc_feature: HIJSMM301BUQ8C.3.38.D05.1.454.light.4.raw

SEQ ID NO: 573690 - DNA, 496 bp, Homo sapiens
  misc_feature: HIJSMM301EITM1.51.55.E11.1.454.light.4.raw
cgatcgtatacacgaccggtgctcgatttagcactcgcacgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 573691 - DNA, 488 bp, Homo sapiens
  misc_feature: HIJSMM301EFN89.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttaggccaggggaccaaactggacatcaaacgaactgtggctgcaccatctgt

SEQ ID NO: 573692 - DNA, 505 bp, Homo sapiens; identical to SEQ ID NO: 535987
  misc_feature: HIJSMM301BKCKG.18.37.D04.1.454.light.4.raw

SEQ ID NO: 573693 - DNA, 493 bp, Homo sapiens; identical to SEQ ID NO: 536471
  misc_feature: HIJSMM301BT0ZW.3.71.G05.1.454.light.4.raw

SEQ ID NO: 573694 - DNA, 510 bp, Homo sapiens
  misc_feature: HIJSMM301AZQZE.16.66.F11.1.454.light.4.raw
  modified_base (492)..(492): a, c, t, g, unknown or other
tgtactactccacgaccggtgctcgatttagtcacgcgagaagggtgagaagtagtggagcatcccactatggcctgggctccactacttctcaccctcctcgctcactgcacaggttcttgggccaatttctacttactcagcccactctgtgtcggagtctccgggaagacggtaaccatctcctgcaccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttccccnccctcctcgagtagtaca

SEQ ID NO: 573695 - DNA, 493 bp, Homo sapiens
  misc_feature: HIJSMM301DNWCZ.52.87.H10.1.454.light.4.raw
cgcagtacgacacgaccggtgctcgatttagcagtactgcgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgacttattactgtcaggacgtgggacactggcagttttggggtgttcgggacgggagggaccaagttgaccgtcctaggtcagcccaaggctccg

SEQ ID NO: 573696 - DNA, 495 bp, Homo sapiens; identical to SEQ ID NO: 538651
  misc_feature: HIJSMM301EP7CI.10.79.H02.1.454.light.4.raw

SEQ ID NO: 573697 - DNA, 508 bp, Homo sapiens; identical to SEQ ID NO: 541908
  misc_feature: HIJSMM301B9SQW.47.85.H08.1.454.light.4.raw

SEQ ID NO: 573698 - DNA, 353 bp, Homo sapiens; identical to SEQ ID NO: 536338
  misc_feature: HIJSMM301DTSHF.3.11.A11.1.454.light.4.raw

SEQ ID NO: 573699 - DNA, 499 bp, Homo sapiens
  misc_feature: HIJSMM301C6THD.4.27.C05.1.454.light.4.raw
  modified_base (406)..(406): a, c, t, g, unknown or other
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctntcacacgtggacagtgggcactgcgtatcgttcggcggaggaccaagctgaccgtcgtggtcacgccaaggctccgcccctcggtcacttccg

SEQ ID NO: 573700 - DNA, 482 bp, Homo sapiens; identical to SEQ ID NO: 540521
  misc_feature: HIJSMM301DC82Z.21.25.C03.1.454.light.4.raw

SEQ ID NO: 573701 - DNA, 496 bp, Homo sapiens
  misc_feature: HIJSMM301CGVR0.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtacaaacgaactgtggctgcaccatctgtcttcatcttcccgt

SEQ ID NO: 573702 - DNA, 488 bp, Homo sapiens; identical to SEQ ID NO: 535861
  misc_feature: HIJSMM301EHTN4.14.55.E11.1.454.light.4.raw

SEQ ID NO: 573703 - DNA, 499 bp, Homo sapiens; identical to SEQ ID NO: 545202
  misc_feature: HIJSMM301DILFT.12.26.C04.1.454.light.4.raw

SEQ ID NO: 573704 - DNA, 497 bp, Homo sapiens
  misc_feature: HIJSMM301DK3NV.43.34.D01.1.454.light.4.raw
tgtgagtagtcacgaccggtgctcgattagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtctaggtcagcccaaggccaaccca

SEQ ID NO: 573705 - DNA, 494 bp, Homo sapiens; identical to SEQ ID NO: 534992
  misc_feature: HIJSMM301AIUC0.9.1.A01.1.454.light.4.raw

SEQ ID NO: 573706 - DNA, 490 bp, Homo sapiens
  misc_feature: HIJSMM301AE5MH.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggacggagatcagacgaactgtggctgcaccatctgtcttcta

SEQ ID NO: 573707 - DNA, 446 bp, Homo sapiens
  misc_feature: HIJSMM301C9PUB.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtctaagtcagcccaaggccaacccctctgtcactctgttcccaccctcctccatactcgta

SEQ ID NO: 573708 - DNA, 468 bp, Homo sapiens
  misc_feature: HIJSMM301BQQNG.51.34.D01.1.454.light.4.raw
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaattataacagggccgttgcgctcactttcggcgggggaccgaaggtggagatc

SEQ ID NO: 573709 - DNA, 508 bp, Homo sapiens
  misc_feature: HIJSMM301BMR1B.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccaaggtaggaaatacaaacgaactagtggctgcaccatctgtcttctactcttccccg

SEQ ID NO: 573710 - DNA, 497 bp, Homo sapiens
  misc_feature: HIJSMM301A7NOY.41.34.D01.1.454.light.4.raw
tctatactatcacgaccggtgctcgatttagatcgtctgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtctaggtcagcccaaggctcg

SEQ ID NO: 573711 - DNA, 510 bp, Homo sapiens; identical to SEQ ID NO: 535474
  misc_feature: HIJSMM301EX1QD.17.33.C11.1.454.light.4.raw

SEQ ID NO: 573712 - DNA, 507 bp, Homo sapiens; identical to SEQ ID NO: 542621
  misc_feature: HIJSMM301DIZAH.4.10.A10.1.454.light.4.raw

SEQ ID NO: 573713 - DNA, 480 bp, Homo sapiens; identical to SEQ ID NO: 559070
  misc_feature: HIJSMM301B6GPA.21.25.C03.1.454.light.4.raw

SEQ ID NO: 573714 - DNA, 496 bp, Homo sapiens; identical to SEQ ID NO: 535612
  misc_feature: HIJSMM301DKD1S.22.9.A09.1.454.light.4.raw

SEQ ID NO: 573715 - DNA, 523 bp, Homo sapiens
  misc_feature: HIJSMM301B5UAE.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccctcc

SEQ ID NO: 573716 - DNA, 503 bp, Homo sapiens; identical to SEQ ID NO: 559148
  misc_feature: HIJSMM301C15RK.7.31.C09.1.454.light.4.raw

SEQ ID NO: 573717 - DNA, 500 bp, Homo sapiens
  misc_feature: HIJSMM301DFY7E.48.77.G11.1.454.light.4.raw
agtatacatacacgaccggtgctcgatttagctagtcactcaagggaaagggggtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactagtggctgcaccatctgtctttcatt

SEQ ID NO: 573718 - DNA, 484 bp, Homo sapiens; identical to SEQ ID NO: 535400
  misc_feature: HIJSMM301AZRQ2.46.26.C04.1.454.light.4.raw

SEQ ID NO: 573719 - DNA, 497 bp, Homo sapiens
  misc_feature: HIJSMM301BOI7O.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagccaaggctcgccccctcggtcactctcgttcccaccctcctcgagtgcgtct

SEQ ID NO: 573720 - DNA, 496 bp, Homo sapiens
  misc_feature: HIJSMM301CPMFU.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggccaagctggagatcaaacgaactgtggctgcaccatctgtt

SEQ ID NO: 573721 - DNA, 502 bp, Homo sapiens; identical to SEQ ID NO: 541971
  misc_feature: HIJSMM301BSJ5G.4.39.D06.1.454.light.4.raw

SEQ ID NO: 573722 - DNA, 460 bp, Homo sapiens; identical to SEQ ID NO: 539553
  misc_feature: HIJSMM301BBIT8.11.86.H09.1.454.light.4.raw

SEQ ID NO: 573723 - DNA, 522 bp, Homo sapiens; identical to SEQ ID NO: 540226
  misc_feature: HIJSMM301AXV1E.27.23.C01.1.454.light.4.raw

SEQ ID NO: 573724 - DNA, 489 bp, Homo sapiens
  misc_feature: HIJSMM301A16Y1.17.67.G01.1.454.light.4.raw
cgtagactagcacgaccggtgctcgatttagagtatacatattgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacagagtctcagtaccccccggacgttcggtccgacgggaccgacggtggaagtacaaacgaaactagtggctgcacca

SEQ ID NO: 573725 - DNA, 520 bp, Homo sapiens; identical to SEQ ID NO: 537173
  misc_feature: HIJSMM301D7HF6.27.23.C01.1.454.light.4.raw

SEQ ID NO: 573726 - DNA, 499 bp, Homo sapiens
  misc_feature: HIJSMM301CNEFA.47.62.F07.1.454.light.4.raw
  modified_base (386)..(386): a, c, t, g, unknown or other
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaaattggtatcagcagaaaccagggaaagcccctaagctcctgatctacgatgcatccaatttggaaacagggtcccatcaaaggttcagtggaagtggatctgggacagattttactttcaccatcagcagcctgcagcctnaagatattgcaacatattactgtcaacagtaatcataaatcttccccactttccggccctcggaccgaaacgtaggataagtacaaacgaaactgtaggctgcaccatctgtt

SEQ ID NO: 573727 - DNA, 522 bp, Homo sapiens; identical to SEQ ID NO: 561516
  misc_feature: HIJSMM301AV2S0.27.23.C01.1.454.light.4.raw

SEQ ID NO: 573728 - DNA, 504 bp, Homo sapiens
  misc_feature: HIJSMM301DHRKL.41.34.D01.1.454.light.4.raw
tctatactatcacgaccggtgctcgatttagatcgtctgtgttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcagcccaaggctgccccctcggtcactctgttccca

SEQ ID NO: 573729 - DNA, 506 bp, Homo sapiens
  misc_feature: HIJSMM301AW7PZ.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccactgt

SEQ ID NO: 573730 - DNA, 500 bp, Homo sapiens
  misc_feature: HIJSMM301A9ELH.7.5.A05.1.454.light.4.raw
cgtgtctctacacgaccggtgctcgatttagatagatagacagggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctcgaccatctctgggcgtccaggctgaagacgaggctgattattactgcagctcatatacaggcagcagcactcaggttttcggcggagggaccaagctgaccgtcctaggtcagcccaaggctgccccctcggt

SEQ ID NO: 573731 - DNA, 501 bp, Homo sapiens; identical to SEQ ID NO: 536867
  misc_feature: HIJSMM301CY2NV.5.86.H09.1.454.light.4.raw

SEQ ID NO: 573732 - DNA, 489 bp, Homo sapiens
  misc_feature: HIJSMM301BURG7.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacaccccctaatctatgaggtttccagccggttctctggagtgccagaaaggttcagtggcagcgggtcagggacagatttcacactagaaaatcagccgggtgggggctgaggatgttggctatttattactgcatgcaggctatacaccttcctgcctactttggccaggggaccaagctggagatcaggcgaac

SEQ ID NO: 573733 - DNA, 503 bp, Homo sapiens; identical to SEQ ID NO: 565187
  misc_feature: HIJSMM301DCDUR.16.49.E05.1.454.light.4.raw

SEQ ID NO: 573734 - DNA, 504 bp, Homo sapiens
  misc_feature: HIJSMM301CRGIU.7.31.C09.1.454.light.4.raw
cgtgtctctacacgaccggtgctcgatttagacgtctcatcaaggaaggaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagcccaaggctgccccctc

SEQ ID NO: 573735 - DNA, 471 bp, Homo sapiens
  misc_feature: HIJSMM301D043T.10.87.H10.1.454.light.4.raw
catagtagtgcacgaccggtgctcgatttagcagtactgcgttgggtttgggggcaggagtcagacccagtcaggacacagcatggacatgagggtccccgctcagctcctggggctcctgctgctctggctcccaggttccagatgcgacatccagatgacccagtctccatcttccgtgtctgcatctgtaggagacagagtcaccatcacttgtcgggcgagtcagcctattagcagctggttagcctggtatcagcagaagccagggggagcccctaagctcctgatctatgctgcatccagtttgcagagtggggtcccgtcaaggttcagcggcagtggatctgggacagatttcgctctcaccatcaacaacctgcagcctgaggattttgcaacttactactgtcaacaggctagcagtttcccactcactttcggccccggaccaagtggaggtcaaacgaa

SEQ ID NO: 573736 - DNA, 460 bp, Homo sapiens; identical to SEQ ID NO: 539553
  misc_feature: HIJSMM301A3YWF.11.86.H09.1.454.light.4.raw

SEQ ID NO: 573737 - DNA, 509 bp, Homo sapiens
  misc_feature: HIJSMM301A1NNR.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactctgtt

SEQ ID NO: 573738 - DNA, 470 bp, Homo sapiens; identical to SEQ ID NO: 536130
  misc_feature: HIJSMM301CNAJY.7.81.H04.1.454.light.4.raw

SEQ ID NO: 573739 - DNA, 494 bp, Homo sapiens; identical to SEQ ID NO: 541400
  misc_feature: HIJSMM301CPCFY.51.71.G05.1.454.light.4.raw

SEQ ID NO: 573740 - DNA, 481 bp, Homo sapiens
  misc_feature: HIJSMM301BN9TM.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggagctgaggatgttgggctctattattgcatgcaagctctacagtcccgctcactttcggcggagggaccaaggtggagatcaacgaa

SEQ ID NO: 573741 - DNA, 487 bp, Homo sapiens
  misc_feature: HIJSMM301CSGNK.4.61.F06.1.454.light.4.raw
agcactgtagcacgaccggtgctcgatttagctacgctctaagggaaagggggaagacaatgggtttgatttagatcacagaggtgagtttaatgttttacttctgttctcagatgccgccggagaagttgtgctgacgcagtctccaggcaccctgtctttgtctccaggggagagcgccaccctctcctgcaggcccagtgaggcggtaaggagcgattacttagcctggtatcagcagaaacctggccaggctcccaggctcctcatccagggtgcatccaacagggccacgggcatcccagccaggttcagtggccgtgcgtctgggacagtcttcactctcaccatcagcggactggagcctgaagattttgctgtgtattttgtcagcagtatggcacatcaccggtcaccttcggccaagggtcacggctggagattaaacgaactgtggctgcaccatctgtcttcatcttcccgccat

SEQ ID NO: 573742 - DNA, 492 bp, Homo sapiens; identical to SEQ ID NO: 535426
  misc_feature: HIJSMM301DE85X.47.78.H01.1.454.light.4.raw

SEQ ID NO: 573743 - DNA, 500 bp, Homo sapiens; identical to SEQ ID NO: 541872
  misc_feature: HIJSMM301ECT8A.48.82.H05.1.454.light.4.raw

SEQ ID NO: 573744 - DNA, 506 bp, Homo sapiens
  misc_feature: HIJSMM301AVMRJ.3.4.A04.1.454.light.4.raw
agacgcactccacgaccggtgctcgatttagagtagtgatcaggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacgggaccgaacggtggaaagtacaaacgaactagtggctgcaccatctgtctt

SEQ ID NO: 573745 - DNA, 484 bp, Homo sapiens; identical to SEQ ID NO: 535240
  misc_feature: HIJSMM301EE5TB.47.60.F05.1.454.light.4.raw

SEQ ID NO: 573746 - DNA, 509 bp, Homo sapiens
  misc_feature: HIJSMM301AVUW1.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagccaaggctgccccctcggt

SEQ ID NO: 573747 - DNA, 504 bp, Homo sapiens; identical to SEQ ID NO: 567220
  misc_feature: HIJSMM301DOW6Q.48.83.H06.1.454.light.4.raw

SEQ ID NO: 573748 - DNA, 495 bp, Homo sapiens
  misc_feature: HIJSMM301D9DY0.12.27.C05.1.454.light.4.raw
atacgacgtacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacggccaacatcacctgctctggagataaattggggcataaatatgtctgctggtatcaacagaaggcaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagccaaccccactgt

SEQ ID NO: 573749 - DNA, 485 bp, Homo sapiens; identical to SEQ ID NO: 535653
  misc_feature: HIJSMM301B3GUV.47.62.F07.1.454.light.4.raw

SEQ ID NO: 573750 - DNA, 518 bp, Homo sapiens; identical to SEQ ID NO: 555554
  misc_feature: HIJSMM301AEWMT.10.38.D05.1.454.light.4.raw

SEQ ID NO: 573751 - DNA, 493 bp, Homo sapiens; identical to SEQ ID NO: 536007
  misc_feature: HIJSMM301CS2Z3.27.78.H01.1.454.light.4.raw

SEQ ID NO: 573752 - DNA, 500 bp, Homo sapiens
  misc_feature: HIJSMM301CVCKJ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgttggacgttcgaccaacggaccaacggtaggatatcagacgaactagtggcgtg

SEQ ID NO: 573753 - DNA, 518 bp, Homo sapiens
  misc_feature: HIJSMM301B4N1H.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggctgccccctcggtcactctcgttcccgccctcctccacg

SEQ ID NO: 573754 - DNA, 497 bp, Homo sapiens; identical to SEQ ID NO: 564511
  misc_feature: HIJSMM301D7KXD.7.59.F04.1.454.light.4.raw

SEQ ID NO: 573755 - DNA, 480 bp, Homo sapiens
  misc_feature: HIJSMM301A56UQ.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgtagtttattactgtcagcactataataactggcctccgtacagttttggccaggggaccaagctggagatcaaacgaa

SEQ ID NO: 573756 - DNA, 503 bp, Homo sapiens; identical to SEQ ID NO: 541454
  misc_feature: HIJSMM301EROMS.9.12.B01.1.454.light.4.raw

SEQ ID NO: 573757 - DNA, 503 bp, Homo sapiens
  misc_feature: HIJSMM301D8LYD.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactccagaatcggccccaaactcctcctccagaggaataatcagcggccctcaggggtccctgaccgattctctggctccaagtctggcacctcagcctccctgaccatcagtgggctccggtccgaggatggaggctgactattactgtgcatcacgggacgcaacagtgggatgacaatctgagcggttggtgttcggcggaggaccaaactgaccgtcctaggtcacgcccaagg

SEQ ID NO: 573758 - DNA, 469 bp, Homo sapiens
  misc_feature: HIJSMM301BOOQ3.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagatttgcaatttattactgtctgcaggattacacataccctcgaacgttcggccaaggaccgaaggtggaaatcaacgaactagt

SEQ ID NO: 573759 - DNA, 463 bp, Homo sapiens; identical to SEQ ID NO: 535062
  misc_feature: HIJSMM301CGUEE.11.73.G07.1.454.light.4.raw

SEQ ID NO: 573760 - DNA, 487 bp, Homo sapiens
  misc_feature: HIJSMM301DA7FN.53.33.C11.1.454.light.4.raw
cgcgtatacacacgaccggtgctcgatttagagtgagctcgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcaggcgtggggacagcaaccctgattgggtgttcggcggagggaccaaactgaccgtcctaggtcagcccaaggctccg

SEQ ID NO: 573761 - DNA, 484 bp, Homo sapiens; identical to SEQ ID NO: 535441
  misc_feature: HIJSMM301CZOA4.26.60.F05.1.454.light.4.raw

SEQ ID NO: 573762 - DNA, 486 bp, Homo sapiens; identical to SEQ ID NO: 535385
  misc_feature: HIJSMM301AH35S.19.71.G05.1.454.light.4.raw

SEQ ID NO: 573763 - DNA, 503 bp, Homo sapiens
  misc_feature: HIJSMM301ESL3Y.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtctaggtcagcccaaggctgccccctggtcactctcgttcccaccctctcg

SEQ ID NO: 573764 - DNA, 500 bp, Homo sapiens; identical to SEQ ID NO: 540012
  misc_feature: HIJSMM301CWCF9.52.34.D01.1.454.light.4.raw

SEQ ID NO: 573765 - DNA, 447 bp, Homo sapiens
  misc_feature: HIJSMM301A9M1D.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctcgttcccgccctcctccatactcgta

SEQ ID NO: 573766 - DNA, 488 bp, Homo sapiens
  misc_feature: HIJSMM301BFIJH.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttctcgccctcctcga

SEQ ID NO: 573767 - DNA, 466 bp, Homo sapiens
  misc_feature: HIJSMM301DPFJD.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagataattgcaacatattactgtcaacagtatgatcgtctcctcaactttcggccctgggaccagagtggacatagaaacgaa

SEQ ID NO: 573768 - DNA, 503 bp, Homo sapiens; identical to SEQ ID NO: 551084
  misc_feature: HIJSMM301CHQRT.48.26.C04.1.454.light.4.raw

SEQ ID NO: 573769 - DNA, 447 bp, Homo sapiens; identical to SEQ ID NO: 535201
  misc_feature: HIJSMM301DB6J9.18.9.A09.1.454.light.4.raw

SEQ ID NO: 573770 - DNA, 505 bp, Homo sapiens; identical to SEQ ID NO: 546412
  misc_feature: HIJSMM301A0QLV.22.21.B10.1.454.light.4.raw

SEQ ID NO: 573771 - DNA, 516 bp, Homo sapiens
  misc_feature: HIJSMM301D34OC.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggtttcggtcggagggaccaagctgaccgtcctacggtcagcccaacggctgccccctcggtcactctgttccccg

SEQ ID NO: 573772 - DNA, 510 bp, Homo sapiens
  misc_feature: HIJSMM301BNUGE.43.5.A05.1.454.light.4.raw
tgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctcttgggggcaaagctgccctgaccctttcgggtgcgcagcctgaggatgaggctgactattactgcttgctcgcctatgatgctgctcgggttttcggcggagggaccaagttgaccgtcctaggtcagcccaaggcctgccccctggtcactctgttcccgccctcctca

SEQ ID NO: 573773 - DNA, 511 bp, Homo sapiens; identical to SEQ ID NO: 541549
  misc_feature: HIJSMM301B91E6.40.33.C11.1.454.light.4.raw

SEQ ID NO: 573774 - DNA, 511 bp, Homo sapiens; identical to SEQ ID NO: 537464
  misc_feature: HIJSMM301DT02T.7.34.D01.1.454.light.4.raw

SEQ ID NO: 573775 - DNA, 479 bp, Homo sapiens; identical to SEQ ID NO: 537163
  misc_feature: HIJSMM301BD41P.13.73.G07.1.454.light.4.raw

SEQ ID NO: 573776 - DNA, 491 bp, Homo sapiens; identical to SEQ ID NO: 542310
  misc_feature: HIJSMM301CARVE.22.65.F10.1.454.light.4.raw

SEQ ID NO: 573777 - DNA, 507 bp, Homo sapiens; identical to SEQ ID NO: 535641
  misc_feature: HIJSMM301BBDT0.10.88.H11.1.454.light.4.raw

SEQ ID NO: 573778 - DNA, 466 bp, Homo sapiens; identical to SEQ ID NO: 556852
  misc_feature: HIJSMM301ATKRJ.48.2.A02.1.454.light.4.raw

SEQ ID NO: 573779 - DNA, 492 bp, Homo sapiens
  misc_feature: HIJSMM301AP1CA.43.29.C07.1.454.light.4.raw
tgtgagtagtcacgaccggtgctcgatttagagtgctacgaagggaaaggggaggctggtcacacttcttgcaggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcgtaggagggaccagggtggagatcaaacgaact

SEQ ID NO: 573780 - DNA, 441 bp, Homo sapiens
  misc_feature: HIJSMM301ARPH8.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggccagcccaaggctgccccctcggtcactctgttcccgccctcctcgtatctctcg

SEQ ID NO: 573781 - DNA, 503 bp, Homo sapiens; identical to SEQ ID NO: 572925
  misc_feature: HIJSMM301A1ZS1.14.57.F02.1.454.light.4.raw

SEQ ID NO: 573782 - DNA, 505 bp, Homo sapiens
  misc_feature: HIJSMM301C4YD9.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccacgggaccgacgagtagaaatagagacgaaactgtggcgtgcacactctgtcttcactctccgt

SEQ ID NO: 573783 - DNA, 512 bp, Homo sapiens; identical to SEQ ID NO: 539198
  misc_feature: HIJSMM301CEBQU.17.33.C11.1.454.light.4.raw

SEQ ID NO: 573784 - DNA, 475 bp, Homo sapiens; identical to SEQ ID NO: 566557
  misc_feature: HIJSMM301AQUNP.40.23.C01.1.454.light.4.raw

SEQ ID NO: 573785 - DNA, 494 bp, Homo sapiens
  misc_feature: HIJSMM301C0CLT.41.35.D02.1.454.light.4.raw
  modified_base (484)..(484): a, c, t, g, unknown or other
tctatactatcacgaccggtgctcgatttagcacacgatagttgggtttgggggctttgcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctcggtcactctgttcccnccctcctcat

SEQ ID NO: 573786 - DNA, 509 bp, Homo sapiens; identical to SEQ ID NO: 559299
  misc_feature: HIJSMM301CDQO3.17.28.C06.1.454.light.4.raw

SEQ ID NO: 573787 - DNA, 525 bp, Homo sapiens
  misc_feature: HIJSMM301C6HVS.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagactgaccgtcctaggtcagcccaaggctgccccctcggtcacttcttccgtaccctccct

SEQ ID NO: 573788 - DNA, 509 bp, Homo sapiens; identical to SEQ ID NO: 553073
  misc_feature: HIJSMM301C281K.16.1.A01.1.454.light.4.raw

SEQ ID NO: 573789 - DNA, 493 bp, Homo sapiens; identical to SEQ ID NO: 548342
  misc_feature: HIJSMM301C2PUT.27.78.H01.1.454.light.4.raw

SEQ ID NO: 573790 - DNA, 501 bp, Homo sapiens
  misc_feature: HIJSMM301A5FJ2.9.71.G05.1.454.light.4.raw
tgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttgggttcctctttcaagatattcggcggagggaccaggctgaccgtcctgagtcagcccaaggctgcccccc

SEQ ID NO: 573791 - DNA, 491 bp, Homo sapiens
  misc_feature: HIJSMM301CF2V4.52.54.E10.1.454.light.4.raw
cgcagtacgacacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggcctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccca

SEQ ID NO: 573792 - DNA, 486 bp, Homo sapiens
  misc_feature: HIJSMM301EM2Z0.41.11.A11.1.454.light.4.raw
tctatactatcacgaccggtgctcgatttagctacgactgcagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttggactttggtcagggacaagctggagatcagacgaactgtggctgcaccatctgtcttcta

SEQ ID NO: 573793 - DNA, 497 bp, Homo sapiens; identical to SEQ ID NO: 536376
  misc_feature: HIJSMM301A5UAM.22.9.A09.1.454.light.4.raw

SEQ ID NO: 573794 - DNA, 485 bp, Homo sapiens
  misc_feature: HIJSMM301D1T1F.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaaacgaactgtggctgca

SEQ ID NO: 573795 - DNA, 503 bp, Homo sapiens
  misc_feature: HIJSMM301B3ODH.13.55.E11.1.454.light.4.raw
tcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccaaggcgcctaatttataatgtttttacccgggactctggggtcccagacagattcagcggcagtgggtcaggcactgatttcacattgaaaatcaccagggtggaggctgaggatgttgggatttattactgcatgcaagctacattctggcctttcactttcggccctggaccaaagtggataccaatcgaactgtggctgcaccatctgtt

SEQ ID NO: 573796 - DNA, 506 bp, Homo sapiens
  misc_feature: HIJSMM301CYD8P.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 573797 - DNA, 493 bp, Homo sapiens; identical to SEQ ID NO: 535745
  misc_feature: HIJSMM301CRH3L.47.78.H01.1.454.light.4.raw

SEQ ID NO: 573798 - DNA, 487 bp, Homo sapiens
  misc_feature: HIJSMM301BJ10X.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttaggccaggggaccaagctggagatcaaacgaactgtggctgcaccat

SEQ ID NO: 573799 - DNA, 505 bp, Homo sapiens
  misc_feature: HIJSMM301BMA8Z.9.71.G05.1.454.light.4.raw
tgatacgtctcacgaccggtgctcgatttagtgtcgtcgcaagagagaggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggcctcaggggtttctggtcgcttctctgcctccaagtctggcaacacggcctccctgacaatctctggctccagtctgacgacgaggctgattattactgcagctcatatgcagttggttcctcttttcaagatatttcggcggagggaccaggctgaccgtcctgagtcagcccaaggctgtccccccg

SEQ ID NO: 573800 - DNA, 524 bp, Homo sapiens
  misc_feature: HIJSMM301BRN25.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatccaccgaggggtcgaaggccggggatggacggccgactattattgtcaggtgtggtatttcagtagtattcagttccgggggtttcggcggagggaccaagctgaccgtcctaggtcacgcccaaggctcgccccctcggtcactctcgttcccgt

SEQ ID NO: 573801 - DNA, 507 bp, Homo sapiens; identical to SEQ ID NO: 540930
  misc_feature: HIJSMM301DEOTH.8.34.D01.1.454.light.4.raw

SEQ ID NO: 573802 - DNA, 502 bp, Homo sapiens
  misc_feature: HIJSMM301BSZSY.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcgggcggagggacccacctgaccgtcttaggtcagcccaaggctgccccctcggtca

SEQ ID NO: 573803 - DNA, 506 bp, Homo sapiens; identical to SEQ ID NO: 534969
  misc_feature: HIJSMM301C1DXU.18.37.D04.1.454.light.4.raw

SEQ ID NO: 573804 - DNA, 488 bp, Homo sapiens
  misc_feature: HIJSMM301E1FON.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccaggggaccaagctggagatacaaacgaactgtggctgcaccat

SEQ ID NO: 573805 - DNA, 460 bp, Homo sapiens; identical to SEQ ID NO: 539553
  misc_feature: HIJSMM301APXBR.11.86.H09.1.454.light.4.raw

SEQ ID NO: 573806 - DNA, 506 bp, Homo sapiens; identical to SEQ ID NO: 534969
  misc_feature: HIJSMM301CCZKT.18.37.D04.1.454.light.4.raw

SEQ ID NO: 573807 - DNA, 510 bp, Homo sapiens
  misc_feature: HIJSMM301BXHSH.48.30.C08.1.454.light.4.raw
agtatacatacacgaccggtgctcgatttagtctgacgtcaaagggaaaggggtgctcgatttagtctgacgtcaaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttggtccaagggacacgact

SEQ ID NO: 573808 - DNA, 494 bp, Homo sapiens; identical to SEQ ID NO: 534994
  misc_feature: HIJSMM301DXZMB.27.78.H01.1.454.light.4.raw

SEQ ID NO: 573809 - DNA, 490 bp, Homo sapiens
  misc_feature: HIJSMM301A4LSA.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgatttattactgcagctcatatagaagtggcagcactctcgtattcggcggtgggaccaagctgaccgtctaggtcagccc

SEQ ID NO: 573810 - DNA, 497 bp, Homo sapiens; identical to SEQ ID NO: 540619
  misc_feature: HIJSMM301AF6FW.15.25.C03.1.454.light.4.raw

SEQ ID NO: 573811 - DNA, 512 bp, Homo sapiens
  misc_feature: HIJSMM301C8R7W.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccaccctcct

SEQ ID NO: 573812 - DNA, 502 bp, Homo sapiens
  misc_feature: HIJSMM301ADEHL.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcgagggaccaagctgaccgtcctggtcagcccaaggctgccccctcggtcta

SEQ ID NO: 573813 - DNA, 504 bp, Homo sapiens; identical to SEQ ID NO: 535561
  misc_feature: HIJSMM301D6ON0.4.57.F02.1.454.light.4.raw

SEQ ID NO: 573814 - DNA, 485 bp, Homo sapiens
  misc_feature: HIJSMM301AKHF6.4.1.A01.1.454.light.4.raw
agcactgtagcacgaccggtgctcgatttagacgtctcatcgaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtcttcta

SEQ ID NO: 573815 - DNA, 473 bp, Homo sapiens; identical to SEQ ID NO: 556826
  misc_feature: HIJSMM301CSBJN.15.8.A08.1.454.light.4.raw

SEQ ID NO: 573816 - DNA, 488 bp, Homo sapiens
  misc_feature: HIJSMM301A18OF.14.55.E11.1.454.light.4.raw
  modified_base (384)..(384): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagnttttgcaacttactactgtcaacagagttacagtacccccctcactttcggcggagggaccaaggcggagatcagacgaactgtggctgcaccatctgtctcta

SEQ ID NO: 573817 - DNA, 484 bp, Homo sapiens
  misc_feature: HIJSMM301EJV9Q.5.71.G05.1.454.light.4.raw
atcagacacgcacgaccggtgctcgatttagtgtcgtcgcaagagagaggggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtgtcttacacagctccagcaataagaaccacttagcttggtaccagcagaaaccaggacagcctcctaaggtactcatttactgggcatctacccggggatccggggtccctgaccgattcagtggcagcgggtctgggacagatttcactctcaccatcagcagtctgcaggctgaagatgtggcagtttatactgtcagcaatattataccactccgtgcagttttggcctgggaccaagctggagatcaaacgaa

SEQ ID NO: 573818 - DNA, 496 bp, Homo sapiens; identical to SEQ ID NO: 536248
  misc_feature: HIJSMM301AWORO.22.27.C05.1.454.light.4.raw

SEQ ID NO: 573819 - DNA, 505 bp, Homo sapiens
  misc_feature: HIJSMM301EEX9S.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatcaaacgaactagtggctgcaccactctgtcttctatcttccccg

SEQ ID NO: 573820 - DNA, 488 bp, Homo sapiens; identical to SEQ ID NO: 537527
  misc_feature: HIJSMM301AWOGD.26.78.H01.1.454.light.4.raw

SEQ ID NO: 573821 - DNA, 504 bp, Homo sapiens
  misc_feature: HIJSMM301CSD9O.48.26.C04.1.454.light.4.raw
agtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggtccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctcggt

SEQ ID NO: 573822 - DNA, 486 bp, Homo sapiens; identical to SEQ ID NO: 545898
  misc_feature: HIJSMM301BKLGY.7.75.G09.1.454.light.4.raw

SEQ ID NO: 573823 - DNA, 500 bp, Homo sapiens
  misc_feature: HIJSMM301BJG5K.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggccaacccacctgcta

SEQ ID NO: 573824 - DNA, 500 bp, Homo sapiens
  misc_feature: HIJSMM301EAS77.51.58.F03.1.454.light.4.raw
cgatcgtatacacgaccggtgctcgatttagtctgatcgagaagggaaaggggtgatcaggactcctcagttcaccttctcacaatgaggctccctgctcagctcctggggctgctaatgctctgggtcccagcatccagtggagatgttgtgctgactcagtctccactctccctgtccgtcacccttggacagccagcttccatctcctgcaggtctagtcaaagcctcgtttatagtgttggaaacacctacttgaattggtttcatcagaggccgggccaatctccaaggcgcctgatttataaggtttctaaccgggactctggggtcccagacagattcagcggcagtgggtcaggcactcatttcacactgaggatcagcagggtggaggctgaggatgttggggtttattactgcatgcaaggtacacactggcctcctatcaccttcggccaagggacacgactggaggttaacgaactgtggctgcacta

SEQ ID NO: 573825 - DNA, 479 bp, Homo sapiens; identical to SEQ ID NO: 535665
  misc_feature: HIJSMM301AIU8G.12.10.A10.1.454.light.4.raw

SEQ ID NO: 573826 - DNA, 466 bp, Homo sapiens
  misc_feature: HIJSMM301CONO2.48.2.A02.1.454.light.4.raw
agtatacatacacgaccggtgctcgatttagactcatctacagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccaggggaccaaagtggatgtcaccgaa

SEQ ID NO: 573827 - DNA, 521 bp, Homo sapiens; identical to SEQ ID NO: 539470
  misc_feature: HIJSMM301BWI0J.27.23.C01.1.454.light.4.raw

SEQ ID NO: 573828 - DNA, 471 bp, Homo sapiens
  misc_feature: HIJSMM301AYWZC.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctcaacgtgatgatgttgcaacatactattgtcagcaatatgattttgctctccgagtgccacttttggcggggggtaccaaggtggacatcaaacgaa

SEQ ID NO: 573829 - DNA, 514 bp, Homo sapiens; identical to SEQ ID NO: 542317
  misc_feature: HIJSMM301EEOFR.9.74.G08.1.454.light.4.raw

SEQ ID NO: 573830 - DNA, 499 bp, Homo sapiens
  misc_feature: HIJSMM301AL5KJ.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccactg

SEQ ID NO: 573831 - DNA, 485 bp, Homo sapiens; identical to SEQ ID NO: 535363
  misc_feature: HIJSMM301C388S.17.26.C04.1.454.light.4.raw

SEQ ID NO: 573832 - DNA, 499 bp, Homo sapiens
  misc_feature: HIJSMM301D3H8R.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtccaggtcagcccaaggccaaccca

SEQ ID NO: 573833 - DNA, 510 bp, Homo sapiens
  misc_feature: HIJSMM301CW9J4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcacccatcagcagcctgcaggctgaagatgtggcagtttattactgtcaacagttttctcgggcgttcggtccaagggaccgaaggtaggaaagtacaaacgaactagtggcgtgcaccatctgtcttcatcttccccg

SEQ ID NO: 573834 - DNA, 485 bp, Homo sapiens
  misc_feature: HIJSMM301AVZC8.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaacgtgaccgtcctaggtcagcccaaggctgcccccc

SEQ ID NO: 573835 - DNA, 491 bp, Homo sapiens
  misc_feature: HIJSMM301EG4IK.49.30.C08.1.454.light.4.raw
agtcgagagacacgaccggtgctcgatttagtctgacgtcaaagggaaagggggagaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcaccta

SEQ ID NO: 573836 - DNA, 507 bp, Homo sapiens
  misc_feature: HIJSMM301CV6EO.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaagggtgaccgtccctagggtcagcccaaggctgccccccg

SEQ ID NO: 573837 - DNA, 491 bp, Homo sapiens
  misc_feature: HIJSMM301A0S4O.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgcgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtctt

SEQ ID NO: 573838 - DNA, 489 bp, Homo sapiens; identical to SEQ ID NO: 535139
  misc_feature: HIJSMM301AZS99.14.55.E11.1.454.light.4.raw

SEQ ID NO: 573839 - DNA, 484 bp, Homo sapiens
  misc_feature: HIJSMM301CT4L2.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcacttactattgtcaacaggctaacagtttccctttaatcttcggccaagggacacgactggagattaaacgaactgtgctgcaccta

SEQ ID NO: 573840 - DNA, 488 bp, Homo sapiens; identical to SEQ ID NO: 542699
  misc_feature: HIJSMM301B6DRG.12.51.E07.1.454.light.4.raw

SEQ ID NO: 573841 - DNA, 447 bp, Homo sapiens; identical to SEQ ID NO: 535201
  misc_feature: HIJSMM301DU34O.18.9.A09.1.454.light.4.raw

SEQ ID NO: 573842 - DNA, 471 bp, Homo sapiens
  misc_feature: HIJSMM301CY5IB.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaggtcacgtcctagtcagaccc

SEQ ID NO: 573843 - DNA, 488 bp, Homo sapiens
  misc_feature: HIJSMM301EYF17.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgctaacttactactgtcagcaggctaacaggctcgcccccaaccttcggccaggggacacgactggagattaaacgaactgtggctgcaccatctgtt

SEQ ID NO: 573844 - DNA, 486 bp, Homo sapiens; identical to SEQ ID NO: 537428
  misc_feature: HIJSMM301AJL3B.47.62.F07.1.454.light.4.raw

SEQ ID NO: 573845 - DNA, 490 bp, Homo sapiens
  misc_feature: HIJSMM301DDAQS.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccctctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtctacc

SEQ ID NO: 573846 - DNA, 521 bp, Homo sapiens; identical to SEQ ID NO: 538715
  misc_feature: HIJSMM301DUHC3.27.23.C01.1.454.light.4.raw

SEQ ID NO: 573847 - DNA, 507 bp, Homo sapiens; identical to SEQ ID NO: 536226
  misc_feature: HIJSMM301DJ99E.18.37.D04.1.454.light.4.raw

SEQ ID NO: 573848 - DNA, 496 bp, Homo sapiens; identical to SEQ ID NO: 548177
  misc_feature: HIJSMM301B6NWA.18.59.F04.1.454.light.4.raw

SEQ ID NO: 573849 - DNA, 486 bp, Homo sapiens
  misc_feature: HIJSMM301AGPT8.46.26.C04.1.454.light.4.raw
  modified_base (445)..(445): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgntcactttcggcggagggaccaaggtggagatcaaacgtaac

SEQ ID NO: 573850 - DNA, 513 bp, Homo sapiens; identical to SEQ ID NO: 565434
  misc_feature: HIJSMM301DW00E.16.1.A01.1.454.light.4.raw

SEQ ID NO: 573851 - DNA, 444 bp, Homo sapiens; identical to SEQ ID NO: 535856
  misc_feature: HIJSMM301CFUMU.9.9.A09.1.454.light.4.raw

SEQ ID NO: 573852 - DNA, 522 bp, Homo sapiens
  misc_feature: HIJSMM301AHO9T.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcggagggaccaggctgaccgtcctaggtcagcccaaggctgccccctcggtcactctgttcccgccct

SEQ ID NO: 573853 - DNA, 507 bp, Homo sapiens; identical to SEQ ID NO: 535641
  misc_feature: HIJSMM301CCXLH.10.88.H11.1.454.light.4.raw

SEQ ID NO: 573854 - DNA, 501 bp, Homo sapiens
  misc_feature: HIJSMM301DARQT.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtcctaggtcagcccaaggccaaccca

SEQ ID NO: 573855 - DNA, 454 bp, Homo sapiens; identical to SEQ ID NO: 535705
  misc_feature: HIJSMM301DZEW4.5.86.H09.1.454.light.4.raw

SEQ ID NO: 573856 - DNA, 525 bp, Homo sapiens
  misc_feature: HIJSMM301EU2BR.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgttatatgggttttgggtcgatttcggttgttcggtcgggagggacccgacggtgaccgtccctacgtccagcccaacggcg

SEQ ID NO: 573857 - DNA, 463 bp, Homo sapiens; identical to SEQ ID NO: 535062
  misc_feature: HIJSMM301EOSZN.11.73.G07.1.454.light.4.raw

SEQ ID NO: 573858 - DNA, 493 bp, Homo sapiens
  misc_feature: HIJSMM301AX3KH.49.20.B09.1.454.light.4.raw
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagaccttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcactc

SEQ ID NO: 573859 - DNA, 487 bp, Homo sapiens; identical to SEQ ID NO: 537573
  misc_feature: HIJSMM301CJG7Y.3.10.A10.1.454.light.4.raw

SEQ ID NO: 573860 - DNA, 487 bp, Homo sapiens; identical to SEQ ID NO: 538190
  misc_feature: HIJSMM301CFXGV.47.70.G04.1.454.light.4.raw

SEQ ID NO: 573861 - DNA, 521 bp, Homo sapiens
  misc_feature: HIJSMM301DWNY4.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcct

SEQ ID NO: 573862 - DNA, 493 bp, Homo sapiens
  misc_feature: HIJSMM301ATTSX.11.67.G01.1.454.light.4.raw
cgagagataccacgaccggtgctcgatttagagtatacatattgggtttggtgcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtca

SEQ ID NO: 573863 - DNA, 472 bp, Homo sapiens
  misc_feature: HIJSMM301A10FB.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggctgagggaccaaggtggagatcaaacgaactgtggctgcaccat

SEQ ID NO: 573864 - DNA, 477 bp, Homo sapiens
  misc_feature: HIJSMM301DIA1O.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacaggagttcactctcaccatcagcagcctgcagtctgaagatttgcggtttattactgtcagcagtatgataactggctgtacacttttggccaggggaccaagctggagatcaggcgaactgtgg

SEQ ID NO: 573865 - DNA, 505 bp, Homo sapiens; identical to SEQ ID NO: 535503
  misc_feature: HIJSMM301BLHSR.8.28.C06.1.454.light.4.raw

SEQ ID NO: 573866 - DNA, 513 bp, Homo sapiens
  misc_feature: HIJSMM301BKO4E.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaacgggaaccgaacggtaggaaagtacaaacgaactagtggctgcaccatctgtcttctatcttccccg

SEQ ID NO: 573867 - DNA, 446 bp, Homo sapiens
  misc_feature: HIJSMM301ECJCA.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggtctgttcggcggcgggaccaagttgaccgtcctacgtcagcccaaggctgccccctccggtcactctgttcccaccctcctcgacacgcgag

SEQ ID NO: 573868 - DNA, 481 bp, Homo sapiens
  misc_feature: HIJSMM301AYKXG.16.86.H09.1.454.light.4.raw
tgtactactccacgaccggtgctcgatttagtgctatagacttggggtttggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgagtctgattattattgcatctcatatacaaccaacagcactctcgactggtattcggcggagggaccaagctgaccgtcctaggtcagcccaaggctgccccctcggtcactctgttcccaccctcctcgagttagtaca

SEQ ID NO: 573869 - DNA, 515 bp, Homo sapiens
  misc_feature: HIJSMM301DBEP1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaagggaccaaggtggaaaagttacaaaacgaaaccgtagtgggctgcaccactctgtcttcatcttccccg

SEQ ID NO: 573870 - DNA, 514 bp, Homo sapiens
  misc_feature: HIJSMM301BA2ER.49.71.G05.1.454.light.4.raw
agtcgagagacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactgtcactctgttcccgccctcct

SEQ ID NO: 573871 - DNA, 504 bp, Homo sapiens; identical to SEQ ID NO: 558529
  misc_feature: HIJSMM301AH353.41.35.D02.1.454.light.4.raw

SEQ ID NO: 573872 - DNA, 502 bp, Homo sapiens
  misc_feature: HIJSMM301C7J9B.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccca

SEQ ID NO: 573873 - DNA, 521 bp, Homo sapiens; identical to SEQ ID NO: 538715
  misc_feature: HIJSMM301DFCOW.27.23.C01.1.454.light.4.raw

SEQ ID NO: 573874 - DNA, 480 bp, Homo sapiens; identical to SEQ ID NO: 567382
  misc_feature: HIJSMM301DBON4.40.23.C01.1.454.light.4.raw

SEQ ID NO: 573875 - DNA, 476 bp, Homo sapiens; identical to SEQ ID NO: 537812
  misc_feature: HIJSMM301BN4BX.3.82.H05.1.454.light.4.raw

SEQ ID NO: 573876 - DNA, 493 bp, Homo sapiens
  misc_feature: HIJSMM301AOICZ.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttcggccagggacacgactggagattaagcgaactgtggctgcaccatctgtctt

SEQ ID NO: 573877 - DNA, 483 bp, Homo sapiens
  misc_feature: HIJSMM301BTV7S.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggaggaccaagttgaccgtctaggtcagcccaaggctccg

SEQ ID NO: 573878 - DNA, 492 bp, Homo sapiens; identical to SEQ ID NO: 537666
  misc_feature: HIJSMM301DE9RY.43.33.C11.1.454.light.4.raw

SEQ ID NO: 573879 - DNA, 480 bp, Homo sapiens; identical to SEQ ID NO: 535630
  misc_feature: HIJSMM301DENS9.40.59.F04.1.454.light.4.raw

SEQ ID NO: 573880 - DNA, 445 bp, Homo sapiens
  misc_feature: HIJSMM301CWCQZ.7.18.B07.1.454.light.4.raw
cgtgtctctacacgaccggtgctcgatttagtcgctgcgtaagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctcgttcccaccctcctctagagacacg

SEQ ID NO: 573881 - DNA, 487 bp, Homo sapiens; identical to SEQ ID NO: 541583
  misc_feature: HIJSMM301DWKP2.41.57.F02.1.454.light.4.raw

SEQ ID NO: 573882 - DNA, 480 bp, Homo sapiens
  misc_feature: HIJSMM301BZLZK.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaaggaccaaggtggatatcagacgaa

SEQ ID NO: 573883 - DNA, 487 bp, Homo sapiens
  misc_feature: HIJSMM301D0MLW.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaaggtggagatcaaacggtaa

SEQ ID NO: 573884 - DNA, 491 bp, Homo sapiens; identical to SEQ ID NO: 548535
  misc_feature: HIJSMM301B6VGH.51.71.G05.1.454.light.4.raw

SEQ ID NO: 573885 - DNA, 499 bp, Homo sapiens
  misc_feature: HIJSMM301D6RTP.49.67.G01.1.454.light.4.raw
agtcgagagacacgaccggtgctcgatttagagtatacatattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaaggtggaggatcaaacgaaactgtggctgcaccatctgtt

SEQ ID NO: 573886 - DNA, 497 bp, Homo sapiens; identical to SEQ ID NO: 536376
  misc_feature: HIJSMM301CTNRU.22.9.A09.1.454.light.4.raw

SEQ ID NO: 573887 - DNA, 416 bp, Homo sapiens; identical to SEQ ID NO: 539343
  misc_feature: HIJSMM301AFKDC.18.78.H01.1.454.light.4.raw

SEQ ID NO: 573888 - DNA, 508 bp, Homo sapiens; identical to SEQ ID NO: 541919
  misc_feature: HIJSMM301BD8NK.19.72.G06.1.454.light.4.raw

SEQ ID NO: 573889 - DNA, 481 bp, Homo sapiens
  misc_feature: HIJSMM301ER9YD.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaaggtggagagtcaaacgaactagtggctgc

SEQ ID NO: 573890 - DNA, 488 bp, Homo sapiens
  misc_feature: HIJSMM301A48JZ.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttggccaagggaccaaggtggatatcagacgaa

SEQ ID NO: 573891 - DNA, 502 bp, Homo sapiens; identical to SEQ ID NO: 564997
  misc_feature: HIJSMM301DQPQC.9.71.G05.1.454.light.4.raw

SEQ ID NO: 573892 - DNA, 495 bp, Homo sapiens; identical to SEQ ID NO: 557386
  misc_feature: HIJSMM301A1E6S.27.78.H01.1.454.light.4.raw

SEQ ID NO: 573893 - DNA, 504 bp, Homo sapiens; identical to SEQ ID NO: 545659
  misc_feature: HIJSMM301BZ4RY.7.71.G05.1.454.light.4.raw

SEQ ID NO: 573894 - DNA, 416 bp, Homo sapiens; identical to SEQ ID NO: 545902
  misc_feature: HIJSMM301DEWNF.18.78.H01.1.454.light.4.raw

SEQ ID NO: 573895 - DNA, 489 bp, Homo sapiens; identical to SEQ ID NO: 558406
  misc_feature: HIJSMM301C9WBF.19.15.B04.1.454.light.4.raw

SEQ ID NO: 573896 - DNA, 508 bp, Homo sapiens
  misc_feature: HIJSMM301D48XZ.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctgtcacgtcagccaccctgggcatcaccggactccagactggggacgaggccgattattactgcggaacatgggatagcagcctgagtactgtgataatcggcggagggaccaagctgaccgtcctaggtcagcccaaggctgccccctggtcactctgttccc

SEQ ID NO: 573897 - DNA, 489 bp, Homo sapiens
  misc_feature: HIJSMM301AZSUH.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagtattttgactaacttattactgtacaactaggtttatacttttaccctcgttattttccggtccctgggaccacagtagatatacaaacgaactgtgctgcacc

SEQ ID NO: 573898 - DNA, 497 bp, Homo sapiens
  misc_feature: HIJSMM301BTZRX.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctg

SEQ ID NO: 573899 - DNA, 494 bp, Homo sapiens
  misc_feature: HIJSMM301A4RY5.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaactgtgg

SEQ ID NO: 573900 - DNA, 490 bp, Homo sapiens; identical to SEQ ID NO: 535234
  misc_feature: HIJSMM301BCHT4.17.21.B10.1.454.light.4.raw

SEQ ID NO: 573901 - DNA, 502 bp, Homo sapiens
  misc_feature: HIJSMM301E29RN.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccacctgtcact

SEQ ID NO: 573902 - DNA, 497 bp, Homo sapiens; identical to SEQ ID NO: 545672
  misc_feature: HIJSMM301AVTFK.2.49.E05.1.454.light.4.raw

SEQ ID NO: 573903 - DNA, 485 bp, Homo sapiens
  misc_feature: HIJSMM301B30WR.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacaggagttcactctcaccatcagcagcctgcagtctgaagattttgcactttattactgtcagcaatataatgactggttctcgatcaccttcggccaagggacacgactggagattaaacgaactgtggctgcaccatct

SEQ ID NO: 573904 - DNA, 504 bp, Homo sapiens
  misc_feature: HIJSMM301B7L6C.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactagtggctgcaccatct

SEQ ID NO: 573905 - DNA, 493 bp, Homo sapiens
  misc_feature: HIJSMM301BUD6P.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgctaacttattactgccaacagtatcatcatcattgtaatttcggtggagggaccaaaggtggaggtcaaacgaactgtggctgcaccatctgtcttcatt

SEQ ID NO: 573906 - DNA, 511 bp, Homo sapiens
  misc_feature: HIJSMM301CVF56.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccgccctctcga

SEQ ID NO: 573907 - DNA, 489 bp, Homo sapiens; identical to SEQ ID NO: 540247
  misc_feature: HIJSMM301COSOZ.48.75.G09.1.454.light.4.raw

SEQ ID NO: 573908 - DNA, 495 bp, Homo sapiens; identical to SEQ ID NO: 547042
  misc_feature: HIJSMM301BM2NP.51.59.F04.1.454.light.4.raw

SEQ ID NO: 573909 - DNA, 517 bp, Homo sapiens
  misc_feature: HIJSMM301D5SFY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcgtccgaacggaccgaaggtaggaaagtacaaacgaaactaagtggcgtgcgaccaactctgtcttctactcttccccg

SEQ ID NO: 573910 - DNA, 521 bp, Homo sapiens; identical to SEQ ID NO: 539470
  misc_feature: HIJSMM301AIE9E.27.23.C01.1.454.light.4.raw

SEQ ID NO: 573911 - DNA, 489 bp, Homo sapiens; identical to SEQ ID NO: 546040
  misc_feature: HIJSMM301CHSTX.11.12.B01.1.454.light.4.raw

SEQ ID NO: 573912 - DNA, 496 bp, Homo sapiens
  misc_feature: HIJSMM301CFX0G.41.82.H05.1.454.light.4.raw
tctatactatcacgaccggtgctcgatttagtcgagctctctcgcgggagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaactagtggctgcaccatctgtcttcatcttcccgccta

SEQ ID NO: 573913 - DNA, 510 bp, Homo sapiens; identical to SEQ ID NO: 537903
  misc_feature: HIJSMM301A0ESN.48.11.A11.1.454.light.4.raw

SEQ ID NO: 573914 - DNA, 477 bp, Homo sapiens; identical to SEQ ID NO: 567064
  misc_feature: HIJSMM301CWVJQ.26.72.G06.1.454.light.4.raw

SEQ ID NO: 573915 - DNA, 495 bp, Homo sapiens; identical to SEQ ID NO: 556093
  misc_feature: HIJSMM301B0HR8.16.6.A06.1.454.light.4.raw

SEQ ID NO: 573916 - DNA, 477 bp, Homo sapiens; identical to SEQ ID NO: 543928
  misc_feature: HIJSMM301AY74G.16.86.H09.1.454.light.4.raw

SEQ ID NO: 573917 - DNA, 488 bp, Homo sapiens
  misc_feature: HIJSMM301C2099.47.70.G04.1.454.light.4.raw
agctcacgtacacgaccggtgctcgatttagtgtagtgtgaagggaaagggggaggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaaacctcctgatctatgctgcatccagtttgcatagtggggtcccatctaggttcagtggcagtggatctgggacagatttcactctcaccatcagcagtctgcaacctgaagatttgcaacttactactgtcaacagagttacggtacccgtacacttttggccaggggaccaaactggacatcaaacgaactgtggctgcaccatctgtt

SEQ ID NO: 573918 - DNA, 506 bp, Homo sapiens
  misc_feature: HIJSMM301DBG0F.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcagggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgccccccg

SEQ ID NO: 573919 - DNA, 505 bp, Homo sapiens
  misc_feature: HIJSMM301A1JUQ.8.24.C02.1.454.light.4.raw
ctcgcgtgtccacgaccggtgctcgatttagtacagatcgttagggaaaggggggggtcgtcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgcccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagttgaccgtcctaagtcagcccaaggctgccccctc

SEQ ID NO: 573920 - DNA, 441 bp, Homo sapiens; identical to SEQ ID NO: 535074
  misc_feature: HIJSMM301CO9GP.11.3.A03.1.454.light.4.raw

SEQ ID NO: 573921 - DNA, 495 bp, Homo sapiens; identical to SEQ ID NO: 535143
  misc_feature: HIJSMM301EAMBT.51.29.C07.1.454.light.4.raw

SEQ ID NO: 573922 - DNA, 520 bp, Homo sapiens; identical to SEQ ID NO: 553566
  misc_feature: HIJSMM301ATZRG.27.23.C01.1.454.light.4.raw

SEQ ID NO: 573923 - DNA, 519 bp, Homo sapiens
  misc_feature: HIJSMM301EZ6WQ.27.23.C01.1.454.light.4.raw
  modified_base (509)..(509): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactcngttcccgcct

SEQ ID NO: 573924 - DNA, 463 bp, Homo sapiens; identical to SEQ ID NO: 549301
  misc_feature: HIJSMM301AP3D9.11.73.G07.1.454.light.4.raw

SEQ ID NO: 573925 - DNA, 502 bp, Homo sapiens; identical to SEQ ID NO: 543172
  misc_feature: HIJSMM301CLY23.18.59.F04.1.454.light.4.raw

SEQ ID NO: 573926 - DNA, 497 bp, Homo sapiens; identical to SEQ ID NO: 535664
  misc_feature: HIJSMM301BV3Y7.22.14.B03.1.454.light.4.raw

SEQ ID NO: 573927 - DNA, 465 bp, Homo sapiens
  misc_feature: HIJSMM301CPKX1.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaagtatgacactgtcccgctcactttcggcggagggaccaaggtggagatgaagggaa

SEQ ID NO: 573928 - DNA, 457 bp, Homo sapiens; identical to SEQ ID NO: 539745
  misc_feature: HIJSMM301BA6X4.49.83.H06.1.454.light.4.raw

SEQ ID NO: 573929 - DNA, 507 bp, Homo sapiens
  misc_feature: HIJSMM301E1CJJ.43.60.F05.1.454.light.4.raw
  modified_base (493)..(493): a, c, t, g, unknown or other
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgacggtacggacgtcgtacgacgaacgtacgtggtcgtcgtcnccgactactcttcg

SEQ ID NO: 573930 - DNA, 444 bp, Homo sapiens; identical to SEQ ID NO: 535192
  misc_feature: HIJSMM301CW9RC.5.9.A09.1.454.light.4.raw

SEQ ID NO: 573931 - DNA, 509 bp, Homo sapiens
  misc_feature: HIJSMM301B4NYE.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaacgccggagaaattgtgttggcacagtctccagccaccctgtctatgtctccaggggaaagagccaccctctcctgcagggccagtcagagtgttggtacgtccttactctggtaccaacaaaacctggccaggctcccaggctcctcatctatgatgcatccaccagggccactggcataccccgccagattcagtggcagtgggtctgggacagacttcactctcaccatcagcagcctggaccctgaagattttgcagtttattactgtcagcagcggaccaattggcccctctccctcactttcggcgggggaccgaaggtggagctcaaacgaactgtggctgcaccatctgtcttcatcttcccg

SEQ ID NO: 573932 - DNA, 490 bp, Homo sapiens
  misc_feature: HIJSMM301BSMY2.5.48.E04.1.454.light.4.raw
atcagacacgcacgaccggtgctcgatttagagagcgtcacagagagaagggggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaacctggccagtctcccaggctcctcatctctggtgtttccttcagggccactggcgtcccaggcagattcaggggcagtgggtctgggacagacttcactctcaccatcagcagactggagcctgaagactttgtgctgtatttctgtcagcagtatgttttcgcacctttcactttcggcggagggaccaaggtggagagcagacgaactgtggctgcaccat

SEQ ID NO: 573933 - DNA, 460 bp, Homo sapiens; identical to SEQ ID NO: 540069
  misc_feature: HIJSMM301EFCLD.11.86.H09.1.454.light.4.raw

SEQ ID NO: 573934 - DNA, 475 bp, Homo sapiens
  misc_feature: HIJSMM301D1IRI.52.32.C10.1.454.light.4.raw
cgcagtacgacacgaccggtgctcgatttagtatagacatcaacacacaaaggggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgt

SEQ ID NO: 573935 - DNA, 475 bp, Homo sapiens
  misc_feature: HIJSMM301BM4Y4.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctactttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagtattttgctaacttactactgtcaacagagtttcagtatcccttggactttcggccaagggaccaaggtggaaatcaaacgaa

SEQ ID NO: 573936 - DNA, 490 bp, Homo sapiens; identical to SEQ ID NO: 535526
  misc_feature: HIJSMM301D3SI1.26.78.H01.1.454.light.4.raw

SEQ ID NO: 573937 - DNA, 494 bp, Homo sapiens; identical to SEQ ID NO: 536444
  misc_feature: HIJSMM301AY58Z.26.72.G06.1.454.light.4.raw

SEQ ID NO: 573938 - DNA, 497 bp, Homo sapiens; identical to SEQ ID NO: 535286
  misc_feature: HIJSMM301BMOMB.18.59.F04.1.454.light.4.raw

SEQ ID NO: 573939 - DNA, 453 bp, Homo sapiens; identical to SEQ ID NO: 536654
  misc_feature: HIJSMM301DXQH1.19.86.H09.1.454.light.4.raw

SEQ ID NO: 573940 - DNA, 497 bp, Homo sapiens
  misc_feature: HIJSMM301EIWXH.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggaacgatcaagacgaactagtggctgcaccactctgtt

SEQ ID NO: 573941 - DNA, 513 bp, Homo sapiens
  misc_feature: HIJSMM301CVHL3.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtctaggtcagcccaaggctgccccctggtcactctgttcccaccctcctcgctacgtagac

SEQ ID NO: 573942 - DNA, 495 bp, Homo sapiens
  misc_feature: HIJSMM301CJPZL.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctggggacagagttcactctcaccatcagcagcctgcaggctgaagatgtggcagtttattactgtcagcaatatttcgtgctccgtacacttttggccaggggacccaggtggagatcagacgaactgtggctgcaccatctgtcttcatcttcccg

SEQ ID NO: 573943 - DNA, 493 bp, Homo sapiens
  misc_feature: HIJSMM301DU2EU.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctggggacagatttcactctcaccatccgcggtctgcaacctgaagatttcgcaacttactactgtcaacagacttacagtgcccccccgactcaccttcggccaagggacacgactggagattaaacgaaactgtggctgcaccatctgtcttcat

SEQ ID NO: 573944 - DNA, 488 bp, Homo sapiens
  misc_feature: HIJSMM301EQ76H.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatccaggcacagattttacgctgaaaatcagtagggtggaggctgaggatgttggggtttattactgcatgcaagttctacaaacttcctacacttttggccaggggaccaagctggagatcaaacgaa

SEQ ID NO: 573945 - DNA, 489 bp, Homo sapiens
  misc_feature: HIJSMM301DVOVT.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggtcggagggaccgagggtagggaggaatcagacgaa

SEQ ID NO: 573946 - DNA, 506 bp, Homo sapiens; identical to SEQ ID NO: 557319
  misc_feature: HIJSMM301DDY2K.8.42.D09.1.454.light.4.raw

SEQ ID NO: 573947 - DNA, 488 bp, Homo sapiens
  misc_feature: HIJSMM301AY62I.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcgtcggagggaccgacggtggaggatcaaacgaaactgtggctgcaccatctgtcttcta

SEQ ID NO: 573948 - DNA, 506 bp, Homo sapiens
  misc_feature: HIJSMM301B6T5K.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttccccgccctcctcg

SEQ ID NO: 573949 - DNA, 498 bp, Homo sapiens; identical to SEQ ID NO: 536173
  misc_feature: HIJSMM301A6H1J.12.86.H09.1.454.light.4.raw

SEQ ID NO: 573950 - DNA, 485 bp, Homo sapiens
  misc_feature: HIJSMM301CHD7B.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccgggaccaaggtgagatcaaacgaactgtggctgcaccatctgtt

SEQ ID NO: 573951 - DNA, 518 bp, Homo sapiens; identical to SEQ ID NO: 543797
  misc_feature: HIJSMM301BUZDS.19.80.H03.1.454.light.4.raw

SEQ ID NO: 573952 - DNA, 496 bp, Homo sapiens
  misc_feature: HIJSMM301A98VC.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcggtttattactgtcagcagtataataactggcctccacggtacacttttggccaggggaccaagctggagatcaaacgaactgtggctgcaccatctgtt

SEQ ID NO: 573953 - DNA, 506 bp, Homo sapiens
  misc_feature: HIJSMM301BDDIA.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacagttttctcgggcgttcggccaaggaccgaaggtggaaagtacaaacgaactagtggctgcaccatctgtcttcatcttccccg

SEQ ID NO: 573954 - DNA, 485 bp, Homo sapiens
  misc_feature: HIJSMM301D54V6.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctttcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttctaccactcagcagcctgcagcctgagatattgcaacatattactgtcagcagtatgataatactcccgactcaccttacggtccgaacgggacacgactggagattaaacgaaactgtggctgca

SEQ ID NO: 573955 - DNA, 487 bp, Homo sapiens; identical to SEQ ID NO: 536536
  misc_feature: HIJSMM301DSXQB.26.45.E01.1.454.light.4.raw

SEQ ID NO: 573956 - DNA, 510 bp, Homo sapiens; identical to SEQ ID NO: 566324
  misc_feature: HIJSMM301A3AIY.5.60.F05.1.454.light.4.raw

SEQ ID NO: 573957 - DNA, 489 bp, Homo sapiens
  misc_feature: HIJSMM301CN2AM.19.71.G05.1.454.light.4.raw
  modified_base (482)..(482): a, c, t, g, unknown or other
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgcaaggacaagtggatatcagacgaactnggctgca

SEQ ID NO: 573958 - DNA, 495 bp, Homo sapiens; identical to SEQ ID NO: 536931
  misc_feature: HIJSMM301CXCPL.10.33.C11.1.454.light.4.raw

SEQ ID NO: 573959 - DNA, 486 bp, Homo sapiens; identical to SEQ ID NO: 535385
  misc_feature: HIJSMM301CWQTZ.19.71.G05.1.454.light.4.raw

SEQ ID NO: 573960 - DNA, 504 bp, Homo sapiens; identical to SEQ ID NO: 545659
  misc_feature: HIJSMM301EM28F.7.71.G05.1.454.light.4.raw

SEQ ID NO: 573961 - DNA, 460 bp, Homo sapiens; identical to SEQ ID NO: 540069
  misc_feature: HIJSMM301DXFH6.11.86.H09.1.454.light.4.raw

SEQ ID NO: 573962 - DNA, 518 bp, Homo sapiens; identical to SEQ ID NO: 539372
  misc_feature: HIJSMM301APR4U.7.86.H09.1.454.light.4.raw

SEQ ID NO: 573963 - DNA, 521 bp, Homo sapiens
  misc_feature: HIJSMM301AKMMV.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcctt

SEQ ID NO: 573964 - DNA, 495 bp, Homo sapiens
  misc_feature: HIJSMM301EN99E.18.11.A11.1.454.light.4.raw
tacgagtatgcacgaccggtgctcgatttagctacgactgcaggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtattttaaagaactccaacaatcagaattacttaacttggtatcagcagaaagcaaggccagcctcccaagttgctcatttactgggcatcaacccgggaatccggggtccctgaccgattcagtggcaggcgggtctgggacagacttcactctcaccatcagcagcctgcaggctgaagatgtggctagtttattactgtcagcagtattatagtactcctccgacgttcggccaagggaccaaggtggagattaaacgaactgtggctgcaccatctgtcttcatcttcccgccat

SEQ ID NO: 573965 - DNA, 515 bp, Homo sapiens
  misc_feature: HIJSMM301A3C7X.49.34.D01.1.454.light.4.raw
agtcgagagacacgaccggtgctcgatttagatcgtctgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctcg

SEQ ID NO: 573966 - DNA, 494 bp, Homo sapiens; identical to SEQ ID NO: 539894
  misc_feature: HIJSMM301BT6JF.16.53.E09.1.454.light.4.raw

SEQ ID NO: 573967 - DNA, 495 bp, Homo sapiens; identical to SEQ ID NO: 535596
  misc_feature: HIJSMM301EENNA.10.79.H02.1.454.light.4.raw

SEQ ID NO: 573968 - DNA, 514 bp, Homo sapiens; identical to SEQ ID NO: 546238
  misc_feature: HIJSMM301DZ38S.47.85.H08.1.454.light.4.raw

SEQ ID NO: 573969 - DNA, 519 bp, Homo sapiens
  misc_feature: HIJSMM301ATH74.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgccaacggaccgaacggtaggaaagtacaagacgaacgtagtaggtcgtgtcgaccactctctcttctatcttcccgtccc

SEQ ID NO: 573970 - DNA, 491 bp, Homo sapiens
  misc_feature: HIJSMM301BGBQT.41.21.B10.1.454.light.4.raw
tctatactatcacgaccggtgctcgatttagtgtcgtcgcaagggggagccctggggaggaactgctcagttaggacccagagggaaccatggaagccccagctcagcttctcttcctcctgctactctggctcccagataccaccggacaaattgtgttgacacagtctccagccaccctgtctttgtctccaggggaaagagccaccctctcctgcagggccagtcagagtgttagcaaccacttagcctggtaccaacagagacctggccagactcccagactcgtcatctatgatgcatccaagagggccactggcatcccagccaggttcagtggcaggtgggtctgggacagacttcactctcaccatcagcagcctagagcctgaagattttgcagtttattactgtcagcagcgtggcgactggcctcgcatcaccttcggccaagggacacgactggagactagacgaactgtggctgcacc

SEQ ID NO: 573971 - DNA, 506 bp, Homo sapiens; identical to SEQ ID NO: 534969
  misc_feature: HIJSMM301CLNV9.18.37.D04.1.454.light.4.raw

SEQ ID NO: 573972 - DNA, 513 bp, Homo sapiens; identical to SEQ ID NO: 535244
  misc_feature: HIJSMM301DZ0HX.17.33.C11.1.454.light.4.raw

SEQ ID NO: 573973 - DNA, 496 bp, Homo sapiens
  misc_feature: HIJSMM301AD4DW.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacgacgactggagattaaacgaactagtggctgcaccatctgtctt

SEQ ID NO: 573974 - DNA, 510 bp, Homo sapiens; identical to SEQ ID NO: 535474
  misc_feature: HIJSMM301AFBK6.17.33.C11.1.454.light.4.raw

SEQ ID NO: 573975 - DNA, 495 bp, Homo sapiens; identical to SEQ ID NO: 538269
  misc_feature: HIJSMM301D4GAD.9.1.A01.1.454.light.4.raw

SEQ ID NO: 573976 - DNA, 485 bp, Homo sapiens; identical to SEQ ID NO: 539576
  misc_feature: HIJSMM301C0ACD.4.57.F02.1.454.light.4.raw

SEQ ID NO: 573977 - DNA, 497 bp, Homo sapiens
  misc_feature: HIJSMM301AJXGG.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgaagggaccgaaagaggacatacaagacgaactagtggcgtgcaccatctgtt

SEQ ID NO: 573978 - DNA, 489 bp, Homo sapiens
  misc_feature: HIJSMM301D1YL5.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcacctcggccaaggacgacgactggagattaaacgaactgtggctgcaccactctgtcttcat

SEQ ID NO: 573979 - DNA, 486 bp, Homo sapiens; identical to SEQ ID NO: 535043
  misc_feature: HIJSMM301DIPCT.46.35.D02.1.454.light.4.raw

SEQ ID NO: 573980 - DNA, 481 bp, Homo sapiens; identical to SEQ ID NO: 535993
  misc_feature: HIJSMM301DTA8P.21.25.C03.1.454.light.4.raw

SEQ ID NO: 573981 - DNA, 502 bp, Homo sapiens
  misc_feature: HIJSMM301D4PED.19.67.G01.1.454.light.4.raw
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctc

SEQ ID NO: 573982 - DNA, 448 bp, Homo sapiens
  misc_feature: HIJSMM301B2DNH.18.9.A09.1.454.light.4.raw
  modified_base (430)..(430): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacagtcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccnccctcctccatactcgta

SEQ ID NO: 573983 - DNA, 487 bp, Homo sapiens; identical to SEQ ID NO: 536536
  misc_feature: HIJSMM301BO92B.26.45.E01.1.454.light.4.raw

SEQ ID NO: 573984 - DNA, 518 bp, Homo sapiens
  misc_feature: HIJSMM301CAA84.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtccaggtcagccaaggctgccccctcggtcactctgttcccgcct

SEQ ID NO: 573985 - DNA, 488 bp, Homo sapiens; identical to SEQ ID NO: 542699
  misc_feature: HIJSMM301DGG1O.12.51.E07.1.454.light.4.raw

SEQ ID NO: 573986 - DNA, 513 bp, Homo sapiens
  misc_feature: HIJSMM301DET8H.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtaggaaatacaaacgaaactgtggctgcaccatctgtcttctatcttcccgccat

SEQ ID NO: 573987 - DNA, 491 bp, Homo sapiens
  misc_feature: HIJSMM301BXCEM.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgctaacttattactgccaacagtatcatcatcattgtaatttcggtggagggaccaaggtggaggtcaaacgaactgtggctgcaccatctgtcttcat

SEQ ID NO: 573988 - DNA, 500 bp, Homo sapiens
  misc_feature: HIJSMM301AUAA9.4.24.C02.1.454.light.4.raw
agcactgtagcacgaccggtgctcgatttagtacagatcgttagggaaaggggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttaattggacgttcggtccaaggggaccgaaacggtgggaaatcagacgaaactgtggctgcaccatctgtcttcta

SEQ ID NO: 573989 - DNA, 501 bp, Homo sapiens; identical to SEQ ID NO: 555551
  misc_feature: HIJSMM301ARO91.21.81.H04.1.454.light.4.raw

SEQ ID NO: 573990 - DNA, 491 bp, Homo sapiens
  misc_feature: HIJSMM301C4VDS.19.25.C03.1.454.light.4.raw
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcagactttcggcggagggaccaaggtggagatcaaacgaactgtggctgcaccatctgtt

SEQ ID NO: 573991 - DNA, 500 bp, Homo sapiens
  misc_feature: HIJSMM301EH97T.10.65.F10.1.454.light.4.raw
  modified_base (492)..(492): a, c, t, g, unknown or other
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtccctcaaggttcagtggcagtggatctgggacagactttactctcaccatcagcgatctgcagcctgacgattttgcgacttactactgtcaacagagtttccggaaccccgttacttcggtcggagggaccgaaggtggagatcaaacgaactgtggctgcaccatctgtcttctancttccccg

SEQ ID NO: 573992 - DNA, 486 bp, Homo sapiens; identical to SEQ ID NO: 535043
  misc_feature: HIJSMM301EFOKD.46.35.D02.1.454.light.4.raw

SEQ ID NO: 573993 - DNA, 498 bp, Homo sapiens
  misc_feature: HIJSMM301AUS64.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaggtggaggatcaaacgaaactgtggctgcaccactcttcgtt

SEQ ID NO: 573994 - DNA, 494 bp, Homo sapiens
  misc_feature: HIJSMM301DA9OG.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgactgtggctgcaccatctgtcttcatcttcccgcc

SEQ ID NO: 573995 - DNA, 498 bp, Homo sapiens
  misc_feature: HIJSMM301BS049.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttccca

SEQ ID NO: 573996 - DNA, 477 bp, Homo sapiens
  misc_feature: HIJSMM301DGI0Y.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcaggtggaggctgaggatgttattgggctctattattgcatgcaagcaacacactggccctacacttttggccagggaccaagctggagatcaatcgaa

SEQ ID NO: 573997 - DNA, 447 bp, Homo sapiens; identical to SEQ ID NO: 535020
  misc_feature: HIJSMM301EBZ7P.18.9.A09.1.454.light.4.raw

SEQ ID NO: 573998 - DNA, 516 bp, Homo sapiens; identical to SEQ ID NO: 550591
  misc_feature: HIJSMM301BLHE8.16.83.H06.1.454.light.4.raw

SEQ ID NO: 573999 - DNA, 497 bp, Homo sapiens
  misc_feature: HIJSMM301CSWXP.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccgacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaatcaaacgaactgtggctgcacc

SEQ ID NO: 574000 - DNA, 495 bp, Homo sapiens
  misc_feature: HIJSMM301B1B8T.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcaagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 574001 - DNA, 472 bp, Homo sapiens; identical to SEQ ID NO: 536302
  misc_feature: HIJSMM301CO9T7.18.76.G10.1.454.light.4.raw

SEQ ID NO: 574002 - DNA, 500 bp, Homo sapiens; identical to SEQ ID NO: 556015
  misc_feature: HIJSMM301BIL48.21.38.D05.1.454.light.4.raw

SEQ ID NO: 574003 - DNA, 506 bp, Homo sapiens; identical to SEQ ID NO: 534969
  misc_feature: HIJSMM301AZ0HH.18.37.D04.1.454.light.4.raw

SEQ ID NO: 574004 - DNA, 494 bp, Homo sapiens; identical to SEQ ID NO: 534992
  misc_feature: HIJSMM301ADNJM.9.1.A01.1.454.light.4.raw

SEQ ID NO: 574005 - DNA, 495 bp, Homo sapiens
  misc_feature: HIJSMM301BFGP5.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcacgcccaaggccaaccca

SEQ ID NO: 574006 - DNA, 488 bp, Homo sapiens
  misc_feature: HIJSMM301BHNE8.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagattttcactctcaccatcaacagtctgcaacctgaagattttgcaacttactactgtcaacagagtttcactacccctctcactttcggtcgggggaccgaacggtggagatcaaacgaaactgtggctgcaccta

SEQ ID NO: 574007 - DNA, 488 bp, Homo sapiens; identical to SEQ ID NO: 551155
  misc_feature: HIJSMM301AT7AD.3.33.C11.1.454.light.4.raw

SEQ ID NO: 574008 - DNA, 508 bp, Homo sapiens
  misc_feature: HIJSMM301A656I.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttggtccaagggaccaaggtggaaagtacaaacgaacctagtggcgtgcaccatctgtcttctatcttccccg

SEQ ID NO: 574009 - DNA, 469 bp, Homo sapiens
  misc_feature: HIJSMM301A3GFG.49.75.G09.1.454.light.4.raw
agtcgagagacacgaccggtgctcgatttagtatagacatcaggggggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatccagcgaactgtggctgcaccatctgtcttcatcttcccgccatctgatct

SEQ ID NO: 574010 - DNA, 479 bp, Homo sapiens; identical to SEQ ID NO: 538734
  misc_feature: HIJSMM301EDKQX.8.53.E09.1.454.light.4.raw

SEQ ID NO: 574011 - DNA, 520 bp, Homo sapiens
  misc_feature: HIJSMM301A283D.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccccgtggacgttcggccaaggaccgaaggtggcaatcaaccgaactagtggctgcaccatctgtcttcatcttccccg

SEQ ID NO: 574012 - DNA, 498 bp, Homo sapiens; identical to SEQ ID NO: 535974
  misc_feature: HIJSMM301A7IMV.22.27.C05.1.454.light.4.raw

SEQ ID NO: 574013 - DNA, 419 bp, Homo sapiens; identical to SEQ ID NO: 562300
  misc_feature: HIJSMM301AP5TV.41.53.E09.1.454.light.4.raw

SEQ ID NO: 574014 - DNA, 479 bp, Homo sapiens
  misc_feature: HIJSMM301E2TMP.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaaactgtggctgcaa

SEQ ID NO: 574015 - DNA, 495 bp, Homo sapiens; identical to SEQ ID NO: 535964
  misc_feature: HIJSMM301CI857.16.10.A10.1.454.light.4.raw

SEQ ID NO: 574016 - DNA, 485 bp, Homo sapiens; identical to SEQ ID NO: 536263
  misc_feature: HIJSMM301A85H0.47.78.H01.1.454.light.4.raw

SEQ ID NO: 574017 - DNA, 482 bp, Homo sapiens; identical to SEQ ID NO: 535352
  misc_feature: HIJSMM301E1HKM.16.81.H04.1.454.light.4.raw

SEQ ID NO: 574018 - DNA, 487 bp, Homo sapiens; identical to SEQ ID NO: 561279
  misc_feature: HIJSMM301AG3EO.19.71.G05.1.454.light.4.raw

SEQ ID NO: 574019 - DNA, 490 bp, Homo sapiens; identical to SEQ ID NO: 537951
  misc_feature: HIJSMM301B6JEY.19.57.F02.1.454.light.4.raw

SEQ ID NO: 574020 - DNA, 506 bp, Homo sapiens; identical to SEQ ID NO: 534969
  misc_feature: HIJSMM301DHDYM.18.37.D04.1.454.light.4.raw

SEQ ID NO: 574021 - DNA, 500 bp, Homo sapiens
  misc_feature: HIJSMM301CP3WY.48.30.C08.1.454.light.4.raw
agtatacatacacgaccggtgctcgatttagtctgacgtcaaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaacgaactgtggctgcaccatctgtcttcatcttcccgccta

SEQ ID NO: 574022 - DNA, 486 bp, Homo sapiens
  misc_feature: HIJSMM301BL5Z8.49.81.H04.1.454.light.4.raw
agtcgagagacacgaccggtgctcgatttagtagtgtagattcgcgggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaataggggtcccatcaaggttcagtggaagtggatctgggacgtattttactttctaccatcatcaacctgcagcctgaggatattgcaacatattactgtcaacaatatgataatctaccactcactttcggcggagggaccacggtggaggatcaaacgaaactgtggctgcaccatctgtcttcta

SEQ ID NO: 574023 - DNA, 486 bp, Homo sapiens
  misc_feature: HIJSMM301ES885.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtggttcccgtcaaggttcactggccgtggatcagggacagaatttactctcaccatcagtagtctacagcctgaagatattgctacttattactgtcagcagagttaccgcgctcccatcactttcggccaagggacacgaccgcagattgacgaactgtggctgcacc

SEQ ID NO: 574024 - DNA, 490 bp, Homo sapiens; identical to SEQ ID NO: 538999
  misc_feature: HIJSMM301BPVYE.16.86.H09.1.454.light.4.raw

SEQ ID NO: 574025 - DNA, 504 bp, Homo sapiens
  misc_feature: HIJSMM301DKAEE.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagcccaaggctgccccctcg

SEQ ID NO: 574026 - DNA, 502 bp, Homo sapiens; identical to SEQ ID NO: 537363
  misc_feature: HIJSMM301DUCTK.18.23.C01.1.454.light.4.raw

SEQ ID NO: 574027 - DNA, 477 bp, Homo sapiens
  misc_feature: HIJSMM301CIZER.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgcatctgaagtatagtct

SEQ ID NO: 574028 - DNA, 444 bp, Homo sapiens; identical to SEQ ID NO: 535192
  misc_feature: HIJSMM301EFVH1.5.9.A09.1.454.light.4.raw

SEQ ID NO: 574029 - DNA, 483 bp, Homo sapiens
  misc_feature: HIJSMM301CMFD9.27.78.H01.1.454.light.4.raw
  modified_base (401)..(401): a, c, t, g, unknown or other
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttntactgtcatcagagtacttactttacctcaagtgatcaccttcggcccaagggacacgactggagattaaacgaactgtggc

SEQ ID NO: 574030 - DNA, 492 bp, Homo sapiens
  misc_feature: HIJSMM301BH45Q.53.22.B11.1.454.light.4.raw
cgcgtatacacacgaccggtgctcgatttagacgacagctcagggcacgaccggtgctcgatttagacgacagctcagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtctacccgg

SEQ ID NO: 574031 - DNA, 444 bp, Homo sapiens; identical to SEQ ID NO: 536484
  misc_feature: HIJSMM301DS3WP.8.11.A11.1.454.light.4.raw

SEQ ID NO: 574032 - DNA, 507 bp, Homo sapiens; identical to SEQ ID NO: 550515
  misc_feature: HIJSMM301B2HQV.12.73.G07.1.454.light.4.raw

SEQ ID NO: 574033 - DNA, 496 bp, Homo sapiens; identical to SEQ ID NO: 539822
  misc_feature: HIJSMM301DCAX1.18.11.A11.1.454.light.4.raw

SEQ ID NO: 574034 - DNA, 497 bp, Homo sapiens; identical to SEQ ID NO: 566464
  misc_feature: HIJSMM301AROWT.11.60.F05.1.454.light.4.raw

SEQ ID NO: 574035 - DNA, 447 bp, Homo sapiens; identical to SEQ ID NO: 535201
  misc_feature: HIJSMM301A7NVL.18.9.A09.1.454.light.4.raw

SEQ ID NO: 574036 - DNA, 488 bp, Homo sapiens
  misc_feature: HIJSMM301D6HA6.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggcccaacccca

SEQ ID NO: 574037 - DNA, 497 bp, Homo sapiens; identical to SEQ ID NO: 536371
  misc_feature: HIJSMM301DM68H.16.78.H01.1.454.light.4.raw

SEQ ID NO: 574038 - DNA, 482 bp, Homo sapiens
  misc_feature: HIJSMM301EPK7B.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcgagggaccaaggtgcagatcaacgaactgtggctgca

SEQ ID NO: 574039 - DNA, 476 bp, Homo sapiens
  misc_feature: HIJSMM301B6WVY.49.28.C06.1.454.light.4.raw
agtcgagagacacgaccggtgctcgatttagagctcacgtattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggaggatcaagcgaactgtggctgca

SEQ ID NO: 574040 - DNA, 494 bp, Homo sapiens; identical to SEQ ID NO: 534994
  misc_feature: HIJSMM301DPY1B.27.78.H01.1.454.light.4.raw

SEQ ID NO: 574041 - DNA, 517 bp, Homo sapiens
  misc_feature: HIJSMM301ELQSG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacgggacgaacggtggaagtcaacgaacagtggctgcaccactctgtcttctactcttcccgtccactctcgat

SEQ ID NO: 574042 - DNA, 480 bp, Homo sapiens
  misc_feature: HIJSMM301BTXYQ.17.39.D06.1.454.light.4.raw
  modified_base (478)..(478): a, c, t, g, unknown or other
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtaggaatcaaacgaactgngg

SEQ ID NO: 574043 - DNA, 507 bp, Homo sapiens; identical to SEQ ID NO: 536258
  misc_feature: HIJSMM301BFI8I.4.57.F02.1.454.light.4.raw

SEQ ID NO: 574044 - DNA, 503 bp, Homo sapiens
  misc_feature: HIJSMM301D5QPR.22.46.E02.1.454.light.4.raw
acatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttactgctgctcatatgcaggcaactataatatggtcttcggcggagggaccaaagtgaccgtcctaggtcagcccaaggctgccccctggtc

SEQ ID NO: 574045 - DNA, 486 bp, Homo sapiens; identical to SEQ ID NO: 537583
  misc_feature: HIJSMM301BE0FC.17.25.C03.1.454.light.4.raw

SEQ ID NO: 574046 - DNA, 516 bp, Homo sapiens
  misc_feature: HIJSMM301AMSDJ.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacgggatgaggctgactattattgtcaggtgtgggacagcaccacggtgatattcggcggcgggaccaagctgaccgtcctaggtcagcccaaggctgccccctcggtcactcctgttcccaccctcctct

SEQ ID NO: 574047 - DNA, 486 bp, Homo sapiens
  misc_feature: HIJSMM301B14LD.14.55.E11.1.454.light.4.raw
  modified_base (426)..(426): a, c, t, g, unknown or other
cgtctagtaccacgaccggtgctcgatttagcactcgcacgttgggtttgggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggagggaccaaggcggagatcagacgaactgtggctgcaccatctgtcttc

SEQ ID NO: 574048 - DNA, 496 bp, Homo sapiens; identical to SEQ ID NO: 537925
  misc_feature: HIJSMM301DI16B.22.14.B03.1.454.light.4.raw

SEQ ID NO: 574049 - DNA, 500 bp, Homo sapiens; identical to SEQ ID NO: 557743
  misc_feature: HIJSMM301C1R3V.15.1.A01.1.454.light.4.raw

SEQ ID NO: 574050 - DNA, 519 bp, Homo sapiens
  misc_feature: HIJSMM301ERLMB.41.19.B08.1.454.light.4.raw
tctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcctc

SEQ ID NO: 574051 - DNA, 494 bp, Homo sapiens; identical to SEQ ID NO: 534992
  misc_feature: HIJSMM301DKYSG.9.1.A01.1.454.light.4.raw

SEQ ID NO: 574052 - DNA, 514 bp, Homo sapiens
  misc_feature: HIJSMM301BSQOX.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtggggatagtagtagtgatcattatgtcttcggatctgggaccagggtcaccgtcctaggtcagcccaaggccaaccccactgtcactctgttcccgccct

SEQ ID NO: 574053 - DNA, 493 bp, Homo sapiens
  misc_feature: HIJSMM301C4IFE.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacagtcaagcgaactgtggctgcaccatctgtt

SEQ ID NO: 574054 - DNA, 495 bp, Homo sapiens; identical to SEQ ID NO: 538269
  misc_feature: HIJSMM301EXHIL.9.1.A01.1.454.light.4.raw

SEQ ID NO: 574055 - DNA, 489 bp, Homo sapiens
  misc_feature: HIJSMM301B46OL.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggagggacaacggcggaggatcagacgaactgtggctgcaccatctgtcttcta

SEQ ID NO: 574056 - DNA, 508 bp, Homo sapiens
  misc_feature: HIJSMM301AIUQ1.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactagtggctgcaccatctgtcttcatcttcccgcc

SEQ ID NO: 574057 - DNA, 490 bp, Homo sapiens
  misc_feature: HIJSMM301D16YE.51.53.E09.1.454.light.4.raw
cgatcgtatacacgaccggtgctcgatttagagagagtgtgttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggt

SEQ ID NO: 574058 - DNA, 488 bp, Homo sapiens
  misc_feature: HIJSMM301DQYT2.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagattttcactctcaccatcagcagtctgcaacctgaagattttgcaacttactactgtcaacagagttacggtaccccgtacacttttggccaggggaccaaactggacatcaaacgaactgtggctgcaccatctgt

SEQ ID NO: 574059 - DNA, 484 bp, Homo sapiens
  misc_feature: HIJSMM301BL89J.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcccgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgcccctcggtcactctgttcccgccctcctcgctacgtaga

SEQ ID NO: 574060 - DNA, 502 bp, Homo sapiens; identical to SEQ ID NO: 549179
  misc_feature: HIJSMM301C6EHZ.14.57.F02.1.454.light.4.raw

SEQ ID NO: 574061 - DNA, 485 bp, Homo sapiens; identical to SEQ ID NO: 539536
  misc_feature: HIJSMM301B3UR3.48.38.D05.1.454.light.4.raw

SEQ ID NO: 574062 - DNA, 486 bp, Homo sapiens; identical to SEQ ID NO: 535385
  misc_feature: HIJSMM301A33H5.19.71.G05.1.454.light.4.raw

SEQ ID NO: 574063 - DNA, 505 bp, Homo sapiens; identical to SEQ ID NO: 550097
  misc_feature: HIJSMM301D5SWL.7.71.G05.1.454.light.4.raw

SEQ ID NO: 574064 - DNA, 509 bp, Homo sapiens; identical to SEQ ID NO: 553073
  misc_feature: HIJSMM301DHU3T.16.1.A01.1.454.light.4.raw

SEQ ID NO: 574065 - DNA, 493 bp, Homo sapiens; identical to SEQ ID NO: 549669
  misc_feature: HIJSMM301BRK39.10.20.B09.1.454.light.4.raw

SEQ ID NO: 574066 - DNA, 487 bp, Homo sapiens; identical to SEQ ID NO: 535583
  misc_feature: HIJSMM301BVDV6.22.73.G07.1.454.light.4.raw

SEQ ID NO: 574067 - DNA, 490 bp, Homo sapiens; identical to SEQ ID NO: 536481
  misc_feature: HIJSMM301BTALR.13.46.E02.1.454.light.4.raw

SEQ ID NO: 574068 - DNA, 491 bp, Homo sapiens; identical to SEQ ID NO: 535294
  misc_feature: HIJSMM301BNXZ9.16.68.G02.1.454.light.4.raw

SEQ ID NO: 574069 - DNA, 489 bp, Homo sapiens
  misc_feature: HIJSMM301A3B8U.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggtccaggggaccaagctggtagatcaaacgaactagtgg

SEQ ID NO: 574070 - DNA, 519 bp, Homo sapiens
  misc_feature: HIJSMM301BE4OV.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggctgccccctcggtccactctcgttcccaccctcctccacg

SEQ ID NO: 574071 - DNA, 486 bp, Homo sapiens
  misc_feature: HIJSMM301BO6JB.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcggccaagggacacgaccgcagattggacgaactgtgctgcacc

SEQ ID NO: 574072 - DNA, 490 bp, Homo sapiens
  misc_feature: HIJSMM301BICO5.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctcgggacgtaaggtaggagagtcagacgaactagtggctgcaccatctgtcttcta

SEQ ID NO: 574073 - DNA, 444 bp, Homo sapiens; identical to SEQ ID NO: 542089
  misc_feature: HIJSMM301BM77P.18.9.A09.1.454.light.4.raw

SEQ ID NO: 574074 - DNA, 504 bp, Homo sapiens
  misc_feature: HIJSMM301COV7X.16.49.E05.1.454.light.4.raw
tgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgcttttggcggtagggaccaaggtgaccgtcctaggtcagcccaaggctgtccccccg

SEQ ID NO: 574075 - DNA, 473 bp, Homo sapiens
  misc_feature: HIJSMM301A2OOS.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaactgggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccgaaggtggacatcaaacgaa

SEQ ID NO: 574076 - DNA, 485 bp, Homo sapiens; identical to SEQ ID NO: 536576
  misc_feature: HIJSMM301AI7SZ.46.35.D02.1.454.light.4.raw

SEQ ID NO: 574077 - DNA, 490 bp, Homo sapiens; identical to SEQ ID NO: 537951
  misc_feature: HIJSMM301BLTY7.19.57.F02.1.454.light.4.raw

SEQ ID NO: 574078 - DNA, 517 bp, Homo sapiens
  misc_feature: HIJSMM301D5YST.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccacactgaccgtcctaggtcagcccaaggctgccccctcggtcactctgttccccg

SEQ ID NO: 574079 - DNA, 492 bp, Homo sapiens
  misc_feature: HIJSMM301C3ZOI.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgaccgggttttattcactttcggccctgggaccaaagtggatttcagacgaactgtggctgcaccatctgtcttcat

SEQ ID NO: 574080 - DNA, 499 bp, Homo sapiens; identical to SEQ ID NO: 540144
  misc_feature: HIJSMM301CHQYT.47.66.F11.1.454.light.4.raw

SEQ ID NO: 574081 - DNA, 509 bp, Homo sapiens
  misc_feature: HIJSMM301BG59I.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgcttgtttttttcggtcggtcgggaccaagctgaccgtcctaggtcagcccaaggctgccccctcggtcta

SEQ ID NO: 574082 - DNA, 487 bp, Homo sapiens
  misc_feature: HIJSMM301BT61O.2.1.A01.1.454.light.4.raw
acgctcgacacacgaccggtgctcgatttagacgtctcatcagggcctgggctctgctattcctcaccctcctcactcagggcacagggtcctgggcccagtctgccctgactcagcctgcctccgtgtctgggtctcctagacagacgctcaacatttcctgcactggaaccagcagtgacgttggtggttatgattctgtctcctggtaccaacaacacccggccagagcccccaaactcttaatttatgatgtcagaaatcggccctcaggggcttctactcgcttctctggctccaagtctggcaacacggcctccctgaccatctcttgggtccaggctgaggacgaggctatatattattgcagttcatatacaagcagtagcacggtggtcttcggcggagggaccaagctgaccgtcctaggtcagcccaaggctcgccccctcggtcactctcgttcccaccctcctctgtcgagcgt

SEQ ID NO: 574083 - DNA, 484 bp, Homo sapiens; identical to SEQ ID NO: 535240
  misc_feature: HIJSMM301DW3J5.47.60.F05.1.454.light.4.raw

SEQ ID NO: 574084 - DNA, 486 bp, Homo sapiens; identical to SEQ ID NO: 536329
  misc_feature: HIJSMM301DJZPP.21.4.A04.1.454.light.4.raw

SEQ ID NO: 574085 - DNA, 480 bp, Homo sapiens; identical to SEQ ID NO: 535291
  misc_feature: HIJSMM301CZECY.22.59.F04.1.454.light.4.raw

SEQ ID NO: 574086 - DNA, 512 bp, Homo sapiens
  misc_feature: HIJSMM301CX6OP.51.53.E09.1.454.light.4.raw
cgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctgtt

SEQ ID NO: 574087 - DNA, 491 bp, Homo sapiens
  misc_feature: HIJSMM301B7KPA.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcgccccc

SEQ ID NO: 574088 - DNA, 433 bp, Homo sapiens
  misc_feature: HIJSMM301DG3E9.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcatcttcccgccatctgacatactcta

SEQ ID NO: 574089 - DNA, 480 bp, Homo sapiens; identical to SEQ ID NO: 551737
  misc_feature: HIJSMM301C67TY.21.25.C03.1.454.light.4.raw

SEQ ID NO: 574090 - DNA, 496 bp, Homo sapiens; identical to SEQ ID NO: 537925
  misc_feature: HIJSMM301E0YQG.22.14.B03.1.454.light.4.raw

SEQ ID NO: 574091 - DNA, 495 bp, Homo sapiens
  misc_feature: HIJSMM301CQP2B.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgagattttgcgacatattactgtcaacagtatgaaaatgtcccgctcactttcggcgggggaccaaggtggagttcaaacgaactgtggctgcaccatctgtcttcatcc

SEQ ID NO: 574092 - DNA, 509 bp, Homo sapiens
  misc_feature: HIJSMM301CBPWX.5.58.F03.1.454.light.4.raw
  modified_base (414)..(414): a, c, t, g, unknown or other
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttacngctgctcatatgcaggtgatcacactttttatgttcgggacttgggaccaaggtcaccgtcctaggtcagcccaaggccacccactgtcatctcg

SEQ ID NO: 574093 - DNA, 492 bp, Homo sapiens; identical to SEQ ID NO: 535126
  misc_feature: HIJSMM301EORXW.18.11.A11.1.454.light.4.raw

SEQ ID NO: 574094 - DNA, 509 bp, Homo sapiens; identical to SEQ ID NO: 547302
  misc_feature: HIJSMM301CZ7LZ.4.57.F02.1.454.light.4.raw

SEQ ID NO: 574095 - DNA, 509 bp, Homo sapiens; identical to SEQ ID NO: 553073
  misc_feature: HIJSMM301CDZZE.16.1.A01.1.454.light.4.raw

SEQ ID NO: 574096 - DNA, 479 bp, Homo sapiens
  misc_feature: HIJSMM301B4WVP.9.76.G10.1.454.light.4.raw
tgatacgtctcacgaccggtgctcgatttagtcactcatacagggggggtagagaagacaggactcagacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgattattactgtggagcatgggatgacagcctgaatgcttggatgttcggcggagggaccaaggctgaccgtcctaggtcagcccaa

SEQ ID NO: 574097 - DNA, 509 bp, Homo sapiens
  misc_feature: HIJSMM301BJKR2.9.43.D10.1.454.light.4.raw
tgatacgtctcacgaccggtgctcgatttagactagcagtaaggggggggtctcaggaggcggcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggagggaccaagctgaccgtcctaggtcagcccaaggctgccccctcggtcactctgttcccgccctcctc

SEQ ID NO: 574098 - DNA, 489 bp, Homo sapiens
  misc_feature: HIJSMM301C4CCZ.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactagtggctgcaccatctgtt

SEQ ID NO: 574099 - DNA, 486 bp, Homo sapiens; identical to SEQ ID NO: 535043
  misc_feature: HIJSMM301CNFS1.46.35.D02.1.454.light.4.raw

SEQ ID NO: 574100 - DNA, 496 bp, Homo sapiens
  misc_feature: HIJSMM301E1N5H.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcattccc

SEQ ID NO: 574101 - DNA, 479 bp, Homo sapiens; identical to SEQ ID NO: 535586
  misc_feature: HIJSMM301COLNK.13.34.D01.1.454.light.4.raw

SEQ ID NO: 574102 - DNA, 486 bp, Homo sapiens; identical to SEQ ID NO: 536323
  misc_feature: HIJSMM301BC6A1.10.2.A02.1.454.light.4.raw

SEQ ID NO: 574103 - DNA, 492 bp, Homo sapiens
  misc_feature: HIJSMM301ASZUQ.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgacgggtggaaagtcaaacgaactagtggctgcaccactcttcg

SEQ ID NO: 574104 - DNA, 474 bp, Homo sapiens
  misc_feature: HIJSMM301ELIIX.52.59.F04.1.454.light.4.raw
cgcagtacgacacgaccggtgctcgatttagtacacacacttagggattgggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaactttatttctgtcataactatgatgatgcccctcacacgttcggccaagggaccaagctggaaatcaaacgaa

SEQ ID NO: 574105 - DNA, 484 bp, Homo sapiens; identical to SEQ ID NO: 535211
  misc_feature: HIJSMM301AL0N2.47.46.E02.1.454.light.4.raw

SEQ ID NO: 574106 - DNA, 484 bp, Homo sapiens; identical to SEQ ID NO: 540581
  misc_feature: HIJSMM301DHPXW.3.88.H11.1.454.light.4.raw

SEQ ID NO: 574107 - DNA, 487 bp, Homo sapiens; identical to SEQ ID NO: 536536
  misc_feature: HIJSMM301BABRF.26.45.E01.1.454.light.4.raw

SEQ ID NO: 574108 - DNA, 522 bp, Homo sapiens
  misc_feature: HIJSMM301BJA1L.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgccgaacggaccgaacggtaggaagtacgaaacgaactacgtggcgtcgcgaccactctgtcttctacttcttcccgtccctact

SEQ ID NO: 574109 - DNA, 490 bp, Homo sapiens; identical to SEQ ID NO: 541974
  misc_feature: HIJSMM301ED7VM.22.65.F10.1.454.light.4.raw

SEQ ID NO: 574110 - DNA, 495 bp, Homo sapiens; identical to SEQ ID NO: 538651
  misc_feature: HIJSMM301C0DWR.10.79.H02.1.454.light.4.raw

SEQ ID NO: 574111 - DNA, 516 bp, Homo sapiens
  misc_feature: HIJSMM301AGP5X.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccgccctcctccg

SEQ ID NO: 574112 - DNA, 506 bp, Homo sapiens; identical to SEQ ID NO: 563474
  misc_feature: HIJSMM301BNW8Q.10.27.C05.1.454.light.4.raw

SEQ ID NO: 574113 - DNA, 497 bp, Homo sapiens; identical to SEQ ID NO: 539718
  misc_feature: HIJSMM301D6FCG.40.54.E10.1.454.light.4.raw

SEQ ID NO: 574114 - DNA, 498 bp, Homo sapiens; identical to SEQ ID NO: 552598
  misc_feature: HIJSMM301CFT9C.12.38.D05.1.454.light.4.raw

SEQ ID NO: 574115 - DNA, 485 bp, Homo sapiens; identical to SEQ ID NO: 535880
  misc_feature: HIJSMM301ASNAS.7.75.G09.1.454.light.4.raw

SEQ ID NO: 574116 - DNA, 494 bp, Homo sapiens; identical to SEQ ID NO: 535680
  misc_feature: HIJSMM301DWYA4.16.78.H01.1.454.light.4.raw

SEQ ID NO: 574117 - DNA, 486 bp, Homo sapiens; identical to SEQ ID NO: 535385
  misc_feature: HIJSMM301AMKYY.19.71.G05.1.454.light.4.raw

SEQ ID NO: 574118 - DNA, 521 bp, Homo sapiens; identical to SEQ ID NO: 538715
  misc_feature: HIJSMM301BLCI7.27.23.C01.1.454.light.4.raw

SEQ ID NO: 574119 - DNA, 504 bp, Homo sapiens
  misc_feature: HIJSMM301ERTU3.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgacttattactgtgcatccacgggacgcaacatgggatgacaatctgagcggttgggtgttcggcggagggaccaaactgaccgtcctaggtcagcccaa

SEQ ID NO: 574120 - DNA, 498 bp, Homo sapiens
  misc_feature: HIJSMM301CKT4W.48.23.C01.1.454.light.4.raw
agtatacatacacgaccggtgctcgatttagtacacgtgattagggattggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcat

SEQ ID NO: 574121 - DNA, 508 bp, Homo sapiens; identical to SEQ ID NO: 550380
  misc_feature: HIJSMM301BMBIT.4.57.F02.1.454.light.4.raw

SEQ ID NO: 574122 - DNA, 479 bp, Homo sapiens; identical to SEQ ID NO: 535586
  misc_feature: HIJSMM301B90SD.13.34.D01.1.454.light.4.raw

SEQ ID NO: 574123 - DNA, 503 bp, Homo sapiens; identical to SEQ ID NO: 540136
  misc_feature: HIJSMM301B9BYY.19.10.A10.1.454.light.4.raw

SEQ ID NO: 574124 - DNA, 511 bp, Homo sapiens
  misc_feature: HIJSMM301C3VIL.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcctact

SEQ ID NO: 574125 - DNA, 485 bp, Homo sapiens
  misc_feature: HIJSMM301CDAAR.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaatcaaacgaactgtggctgcaccatctgtcttct

SEQ ID NO: 574126 - DNA, 487 bp, Homo sapiens
  misc_feature: HIJSMM301DVD6P.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggagatcaaacga

SEQ ID NO: 574127 - DNA, 490 bp, Homo sapiens
  misc_feature: HIJSMM301D4DF4.17.39.D06.1.454.light.4.raw
cgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtaggaaatacaaacgaactgtggcgtgca

SEQ ID NO: 574128 - DNA, 447 bp, Homo sapiens; identical to SEQ ID NO: 535201
  misc_feature: HIJSMM301CY7RR.18.9.A09.1.454.light.4.raw

SEQ ID NO: 574129 - DNA, 484 bp, Homo sapiens; identical to SEQ ID NO: 535400
  misc_feature: HIJSMM301EIWKY.46.26.C04.1.454.light.4.raw

SEQ ID NO: 574130 - DNA, 486 bp, Homo sapiens; identical to SEQ ID NO: 535043
  misc_feature: HIJSMM301BEPI3.46.35.D02.1.454.light.4.raw

SEQ ID NO: 574131 - DNA, 491 bp, Homo sapiens; identical to SEQ ID NO: 561618
  misc_feature: HIJSMM301CLVU1.46.35.D02.1.454.light.4.raw

SEQ ID NO: 574132 - DNA, 447 bp, Homo sapiens; identical to SEQ ID NO: 535020
  misc_feature: HIJSMM301CWMUG.18.9.A09.1.454.light.4.raw

SEQ ID NO: 574133 - DNA, 503 bp, Homo sapiens
  misc_feature: HIJSMM301EWIBT.48.55.E11.1.454.light.4.raw
agtatacatacacgaccggtgctcgatttagcactcgcacgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttccccg

SEQ ID NO: 574134 - DNA, 487 bp, Homo sapiens
  misc_feature: HIJSMM301C51RF.49.28.C06.1.454.light.4.raw
agtcgagagacacgaccggtgctcgatttagagctcacgtattgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcacctttcggcggagggaccagggtggagatcaaacgtaac

SEQ ID NO: 574135 - DNA, 502 bp, Homo sapiens; identical to SEQ ID NO: 539002
  misc_feature: HIJSMM301BGTGI.18.59.F04.1.454.light.4.raw

SEQ ID NO: 574136 - DNA, 493 bp, Homo sapiens; identical to SEQ ID NO: 543205
  misc_feature: HIJSMM301CQYLQ.51.6.A06.1.454.light.4.raw

SEQ ID NO: 574137 - DNA, 493 bp, Homo sapiens; identical to SEQ ID NO: 558126
  misc_feature: HIJSMM301BKCMG.9.1.A01.1.454.light.4.raw

SEQ ID NO: 574138 - DNA, 504 bp, Homo sapiens
  misc_feature: HIJSMM301AQ205.51.23.C01.1.454.light.4.raw
cgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctcttttcggcggagggaccaaggtggagatcaaacgaactgtggctgcaccatctgtcttcatcttcccgccat

SEQ ID NO: 574139 - DNA, 493 bp, Homo sapiens
  misc_feature: HIJSMM301A9CHE.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacatcaagcgaactgtggctgcaccatctgtt

SEQ ID NO: 574140 - DNA, 466 bp, Homo sapiens; identical to SEQ ID NO: 535366
  misc_feature: HIJSMM301C3O3B.13.4.A04.1.454.light.4.raw

SEQ ID NO: 574141 - DNA, 503 bp, Homo sapiens; identical to SEQ ID NO: 536834
  misc_feature: HIJSMM301CRBNR.2.35.D02.1.454.light.4.raw

SEQ ID NO: 574142 - DNA, 511 bp, Homo sapiens
  misc_feature: HIJSMM301EEWUG.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcgggagggaccgaaaataagaaggtacgaacgaaaccgtagtggcgtgcaccactctgtcttc

SEQ ID NO: 574143 - DNA, 492 bp, Homo sapiens
  misc_feature: HIJSMM301APFDF.51.81.H04.1.454.light.4.raw
cgatcgtatacacgaccggtgctcgatttagtagtgtagattcgcgggcacgatgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacccg

SEQ ID NO: 574144 - DNA, 518 bp, Homo sapiens
  misc_feature: HIJSMM301DRINL.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtaggaaagtacaagacgaacgtagtggcgtcggcaccaactctgtcttctatcttcccgt

SEQ ID NO: 574145 - DNA, 501 bp, Homo sapiens
  misc_feature: HIJSMM301BPUFR.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctcgaccatctctgggctccaggctgaagacgaggctgattattacttgcagctcatatacaggcagcagcactcaggttttcggcggagggaccaagctgaccgtcctaggtcacgcccaaggctcgccccctcggt

SEQ ID NO: 574146 - DNA, 500 bp, Homo sapiens
  misc_feature: HIJSMM301DWJ0L.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaacgaactgtggctgcaccatctgtcttcat

SEQ ID NO: 574147 - DNA, 513 bp, Homo sapiens
  misc_feature: HIJSMM301ESCPN.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtaggcagtagatctggaacagattttaccctcaccatcaggggtctacagcctgaagattttgcgacttactattgtcaacagagttaccttctcccccggacgtcgtcacggacgaacggtaggaagtacaagacgaactacgtggcgtgtcaccgactctcgtcttctactcttcccgt

SEQ ID NO: 574148 - DNA, 516 bp, Homo sapiens
  misc_feature: HIJSMM301DWJS4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaaggaccgaacggtggaagtacgaaacgaactagtggcgtgcgaccactctgtcttctatcttcccgtcccact

SEQ ID NO: 574149 - DNA, 505 bp, Homo sapiens; identical to SEQ ID NO: 546412
  misc_feature: HIJSMM301BKB5V.22.21.B10.1.454.light.4.raw

SEQ ID NO: 574150 - DNA, 507 bp, Homo sapiens
  misc_feature: HIJSMM301A6HZA.14.23.C01.1.454.light.4.raw
cgtctagtaccacgaccggtgctcgatttagtacacgtgattagggattgggggagggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgctagtttattattgtcagcagtataataactggcctccgtggacgttcggccgaagggaccgaaggtaggaaagtacaaacgaactagtggctgcaccatctgtcttcta

SEQ ID NO: 574151 - DNA, 492 bp, Homo sapiens
  misc_feature: HIJSMM301AR70Z.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcagggtcgctgatcgcttctctggctccaagtctggcgacacggcctccctgaccatctctgggctccagactgaggatgaggctacttattttgctgctcttatgcaggcagtttcgctctcgaagtgttcggcggaggaccgagctgaccgtcctacgtcagcccaa

SEQ ID NO: 574152 - DNA, 494 bp, Homo sapiens; identical to SEQ ID NO: 534994
  misc_feature: HIJSMM301BWJ6I.27.78.H01.1.454.light.4.raw

SEQ ID NO: 574153 - DNA, 505 bp, Homo sapiens
  misc_feature: HIJSMM301A4BTQ.49.48.E04.1.454.light.4.raw
agtcgagagacacgaccggtgctcgatttagagagcgtcacagagagaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggcccctgtactggtcatctacgaggacagtaaacgaccctccgggatccctgcgagattctctgcctctagttcagggacaatggccaccttgactatcagtggggcccaggtggaggatgaagctgactactatttactcaacagacagcagtgccggagggggtcttcggcgggagggaccaagctgaccgtcctaggtcagcccaaggctgccccctcggtcactctgtt

SEQ ID NO: 574154 - DNA, 498 bp, Homo sapiens
  misc_feature: HIJSMM301CR2KQ.2.49.E05.1.454.light.4.raw
acgctcgacacacgaccggtgctcgatttagagcgactagcaacacacaaaggggggggaggctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccgggcagagggtcaccatctcttgttctggaagcatgtccaacatcggaagtgataatgtatactggtaccagcagttcccaagagcggcccccaagctcctcatctatagaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggacacggtcaccgtcctaggt

SEQ ID NO: 574155 - DNA, 503 bp, Homo sapiens
  misc_feature: HIJSMM301DJN86.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcgagggaccaagctgaccgtcctaggtcagcccaaggctgccccctcggtcta

SEQ ID NO: 574156 - DNA, 485 bp, Homo sapiens
  misc_feature: HIJSMM301ADKTX.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctcgcgtggttttggtcgtgttcggcggcgggaccg

SEQ ID NO: 574157 - DNA, 510 bp, Homo sapiens; identical to SEQ ID NO: 551642
  misc_feature: HIJSMM301AQQ7T.40.33.C11.1.454.light.4.raw

SEQ ID NO: 574158 - DNA, 514 bp, Homo sapiens; identical to SEQ ID NO: 550589
  misc_feature: HIJSMM301CVBZT.16.66.F11.1.454.light.4.raw

SEQ ID NO: 574159 - DNA, 498 bp, Homo sapiens
  misc_feature: HIJSMM301AQ07F.43.55.E11.1.454.light.4.raw
tgtgagtagtcacgaccggtgctcgatttagcactcgcacgttgggtttggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccgaacgtaggaaatacaaacgaactagtggctgcaccatctgtcttcatt

SEQ ID NO: 574160 - DNA, 516 bp, Homo sapiens
  misc_feature: HIJSMM301B7TXV.41.25.C03.1.454.light.4.raw
tctatactatcacgaccggtgctcgatttagtagtgtagatttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccaggtgaccgtcctaggtcagcccaaggctgccccctcggtcactctgttccca

SEQ ID NO: 574161 - DNA, 488 bp, Homo sapiens
  misc_feature: HIJSMM301DZD30.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggatccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgtt

SEQ ID NO: 574162 - DNA, 447 bp, Homo sapiens; identical to SEQ ID NO: 535020
  misc_feature: HIJSMM301AV9J2.18.9.A09.1.454.light.4.raw

SEQ ID NO: 574163 - DNA, 485 bp, Homo sapiens; identical to SEQ ID NO: 541838
  misc_feature: HIJSMM301EJVLC.22.6.A06.1.454.light.4.raw

SEQ ID NO: 574164 - DNA, 509 bp, Homo sapiens
  misc_feature: HIJSMM301AG4YG.40.33.C11.1.454.light.4.raw
tctagcgactcacgaccggtgctcgatttagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcttccatccttgggaacaaagctgccctcaccattacgggggcccagccagaggatgagtcttatttattactgcatgctccatggtgggggtgcccacgttgggtgttcgggcggagggaccaagctgaccgtcctaggtcagcccaaggctcgcccccttc

SEQ ID NO: 574165 - DNA, 527 bp, Homo sapiens
  misc_feature: HIJSMM301APITN.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaaggtacgaaacgaaactacgtggcgtgcaccactctgtcttctatcttcccgtcccactcctg

SEQ ID NO: 574166 - DNA, 507 bp, Homo sapiens
  misc_feature: HIJSMM301AV9NE.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggtcggcgggacccagatgactgtcctcagtcagcccaaggctgccccctcggt

SEQ ID NO: 574167 - DNA, 521 bp, Homo sapiens; identical to SEQ ID NO: 538715
  misc_feature: HIJSMM301D9RG0.27.23.C01.1.454.light.4.raw

SEQ ID NO: 574168 - DNA, 505 bp, Homo sapiens; identical to SEQ ID NO: 535987
  misc_feature: HIJSMM301CP0K8.18.37.D04.1.454.light.4.raw

SEQ ID NO: 574169 - DNA, 487 bp, Homo sapiens; identical to SEQ ID NO: 541444
  misc_feature: HIJSMM301EMIBV.19.71.G05.1.454.light.4.raw

SEQ ID NO: 574170 - DNA, 485 bp, Homo sapiens; identical to SEQ ID NO: 570827
  misc_feature: HIJSMM301COGIQ.47.46.E02.1.454.light.4.raw

SEQ ID NO: 574171 - DNA, 505 bp, Homo sapiens; identical to SEQ ID NO: 538054
  misc_feature: HIJSMM301EE3LC.8.55.E11.1.454.light.4.raw

SEQ ID NO: 574172 - DNA, 509 bp, Homo sapiens
  misc_feature: HIJSMM301A9990.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggaccagaccctggagcctcagttggaagcagccgatccagcctgcggagcctgtggggcaggtcagcccaaggccaaccccactgtcactctgtt

SEQ ID NO: 574173 - DNA, 441 bp, Homo sapiens; identical to SEQ ID NO: 550529
  misc_feature: HIJSMM301BQAWP.41.9.A09.1.454.light.4.raw

SEQ ID NO: 574174 - DNA, 508 bp, Homo sapiens
  misc_feature: HIJSMM301AQJ5Y.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcgccgaagggaccgaaggtaggaaagtacaaacgaactagtggctgcaccatctgtcttcatcttccccg

SEQ ID NO: 574175 - DNA, 502 bp, Homo sapiens
  misc_feature: HIJSMM301BEWUI.21.22.B11.1.454.light.4.raw
  modified_base (461)..(461): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccgggtccgaggatgaggctgactattactgtgcatcacgggacgcaacatgggatgacaatctgagcggttgggngttcggcggagggaccaaactgaccgtctaggtcagcccaa

SEQ ID NO: 574176 - DNA, 517 bp, Homo sapiens
  misc_feature: HIJSMM301DE4UK.40.74.G08.1.454.light.4.raw
tctagcgactcacgaccggtgctcgatttagtagctctatcagggggggggaagctcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgcgatgaggctgactattactgttcagcgtgggatgccagcccgaatcattgggtgttcggcggagggaccaaactgaccgtcctaggtcacgcccaaggctgccccctcggt

SEQ ID NO: 574177 - DNA, 508 bp, Homo sapiens
  misc_feature: HIJSMM301BABP5.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtctacgtcagcccaaggccaacccactgtcactctgttcccta

SEQ ID NO: 574178 - DNA, 497 bp, Homo sapiens; identical to SEQ ID NO: 535286
  misc_feature: HIJSMM301BM3A4.18.59.F04.1.454.light.4.raw

SEQ ID NO: 574179 - DNA, 486 bp, Homo sapiens; identical to SEQ ID NO: 535043
  misc_feature: HIJSMM301AESP9.46.35.D02.1.454.light.4.raw

SEQ ID NO: 574180 - DNA, 482 bp, Homo sapiens
  misc_feature: HIJSMM301A2G0Y.48.40.D07.1.454.light.4.raw
agtatacatacacgaccggtgctcgatttagtgatagagcgtaacaacagaggggctgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggtccaacgggaccgaacggtaggag

SEQ ID NO: 574181 - DNA, 445 bp, Homo sapiens; identical to SEQ ID NO: 542143
  misc_feature: HIJSMM301EBJRM.47.85.H08.1.454.light.4.raw

SEQ ID NO: 574182 - DNA, 507 bp, Homo sapiens
  misc_feature: HIJSMM301EOZAR.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtctaggtcagcccaaggctgccccctcggtcactctgtt

SEQ ID NO: 574183 - DNA, 522 bp, Homo sapiens
  misc_feature: HIJSMM301BB74A.27.23.C01.1.454.light.4.raw
  modified_base (518)..(518): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccnccct

SEQ ID NO: 574184 - DNA, 506 bp, Homo sapiens
  misc_feature: HIJSMM301D81WO.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatactgtagatggtgcctctttcaaggttttcggcggagggaccaggctgaccgtcctaagtcagcccaaggctgccccctggt

SEQ ID NO: 574185 - DNA, 463 bp, Homo sapiens; identical to SEQ ID NO: 535008
  misc_feature: HIJSMM301EJ136.10.9.A09.1.454.light.4.raw

SEQ ID NO: 574186 - DNA, 506 bp, Homo sapiens; identical to SEQ ID NO: 545686
  misc_feature: HIJSMM301CNKXO.18.37.D04.1.454.light.4.raw

SEQ ID NO: 574187 - DNA, 492 bp, Homo sapiens
  misc_feature: HIJSMM301AGUJ8.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcagcaacacactggccgtacacttttggtccaggggaccaagctggagatcaatcgaactgtgg

SEQ ID NO: 574188 - DNA, 495 bp, Homo sapiens
  misc_feature: HIJSMM301BQTMB.27.78.H01.1.454.light.4.raw
agcgtcgtctcacgaccggtgctcgatttagtgtgagtagtttgggtttgggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatccaccttcggccgaagggacacgactggagattaaacgaactgtggctgcaccatctgtctt

SEQ ID NO: 574189 - DNA, 484 bp, Homo sapiens; identical to SEQ ID NO: 539003
  misc_feature: HIJSMM301CM9EE.10.1.A01.1.454.light.4.raw

SEQ ID NO: 574190 - DNA, 491 bp, Homo sapiens
  misc_feature: HIJSMM301BKJLU.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggaccaagctggagatacaaacgaactgt

SEQ ID NO: 574191 - DNA, 504 bp, Homo sapiens; identical to SEQ ID NO: 544677
  misc_feature: HIJSMM301EJVPR.7.71.G05.1.454.light.4.raw

SEQ ID NO: 574192 - DNA, 520 bp, Homo sapiens; identical to SEQ ID NO: 538570
  misc_feature: HIJSMM301BSP97.27.23.C01.1.454.light.4.raw

SEQ ID NO: 574193 - DNA, 510 bp, Homo sapiens
  misc_feature: HIJSMM301CNOBD.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgcctcctccgtgtctgat

SEQ ID NO: 574194 - DNA, 494 bp, Homo sapiens; identical to SEQ ID NO: 537607
  misc_feature: HIJSMM301AW111.52.10.A10.1.454.light.4.raw

SEQ ID NO: 574195 - DNA, 477 bp, Homo sapiens; identical to SEQ ID NO: 535266
  misc_feature: HIJSMM301C5K2L.4.34.D01.1.454.light.4.raw

SEQ ID NO: 574196 - DNA, 505 bp, Homo sapiens; identical to SEQ ID NO: 535987
  misc_feature: HIJSMM301ET8S2.18.37.D04.1.454.light.4.raw

SEQ ID NO: 574197 - DNA, 499 bp, Homo sapiens
  misc_feature: HIJSMM301B2JO5.40.23.C01.1.454.light.4.raw
  modified_base (261)..(261): a, c, t, g, unknown or other
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtacccccaanagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcat

SEQ ID NO: 574198 - DNA, 484 bp, Homo sapiens; identical to SEQ ID NO: 535400
  misc_feature: HIJSMM301DHRJO.46.26.C04.1.454.light.4.raw

SEQ ID NO: 574199 - DNA, 495 bp, Homo sapiens; identical to SEQ ID NO: 539267
  misc_feature: HIJSMM301AM2PZ.21.27.C05.1.454.light.4.raw

SEQ ID NO: 574200 - DNA, 494 bp, Homo sapiens; identical to SEQ ID NO: 552047
  misc_feature: HIJSMM301DLY8V.26.72.G06.1.454.light.4.raw

SEQ ID NO: 574201 - DNA, 492 bp, Homo sapiens
  misc_feature: HIJSMM301C3MIK.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggacccaagctggagatcaaacgaactgt

SEQ ID NO: 574202 - DNA, 441 bp, Homo sapiens; identical to SEQ ID NO: 534971
  misc_feature: HIJSMM301BDDN4.11.3.A03.1.454.light.4.raw

SEQ ID NO: 574203 - DNA, 513 bp, Homo sapiens; identical to SEQ ID NO: 535244
  misc_feature: HIJSMM301AV7S2.17.33.C11.1.454.light.4.raw

SEQ ID NO: 574204 - DNA, 511 bp, Homo sapiens
  misc_feature: HIJSMM301ADJQE.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgttctttttctccgaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaagtaggaaatcaaacgaactgtggctgcaccatctgtcttcatcttcccgccat

SEQ ID NO: 574205 - DNA, 505 bp, Homo sapiens
  misc_feature: HIJSMM301CL51Q.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggaccaaagtggaaatcaaacgaactgtggctgcaccatctgtcttcatcttccgcc

SEQ ID NO: 574206 - DNA, 488 bp, Homo sapiens; identical to SEQ ID NO: 537260
  misc_feature: HIJSMM301CMFRT.47.70.G04.1.454.light.4.raw

SEQ ID NO: 574207 - DNA, 501 bp, Homo sapiens; identical to SEQ ID NO: 538461
  misc_feature: HIJSMM301AFEUQ.13.11.A11.1.454.light.4.raw

SEQ ID NO: 574208 - DNA, 521 bp, Homo sapiens; identical to SEQ ID NO: 538715
  misc_feature: HIJSMM301AX23Z.27.23.C01.1.454.light.4.raw

SEQ ID NO: 574209 - DNA, 491 bp, Homo sapiens
  misc_feature: HIJSMM301AOPMG.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctccccggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatctgtt

SEQ ID NO: 574210 - DNA, 509 bp, Homo sapiens
  misc_feature: HIJSMM301D7SON.48.23.C01.1.454.light.4.raw
agtatacatacacgaccggtgctcgatttagtacacgtgattagggattgggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgccccctc

SEQ ID NO: 574211 - DNA, 514 bp, Homo sapiens; identical to SEQ ID NO: 541418
  misc_feature: HIJSMM301DYW4W.17.33.C11.1.454.light.4.raw

SEQ ID NO: 574212 - DNA, 440 bp, Homo sapiens
  misc_feature: HIJSMM301CR0YI.41.9.A09.1.454.light.4.raw
  modified_base (422)..(422): a, c, t, g, unknown or other
tctatactatcacgaccggtgctcgatttagcgagacgcgcagggtcctgggcccagtctgtcctgactcagccaccctcagcgtctgggacccccggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccnccctcctcatagtataga

SEQ ID NO: 574213 - DNA, 483 bp, Homo sapiens; identical to SEQ ID NO: 535480
  misc_feature: HIJSMM301B5C1T.46.26.C04.1.454.light.4.raw

SEQ ID NO: 574214 - DNA, 499 bp, Homo sapiens; identical to SEQ ID NO: 536578
  misc_feature: HIJSMM301A6UL5.22.27.C05.1.454.light.4.raw

SEQ ID NO: 574215 - DNA, 494 bp, Homo sapiens; identical to SEQ ID NO: 541035
  misc_feature: HIJSMM301CPETZ.26.12.B01.1.454.light.4.raw

SEQ ID NO: 574216 - DNA, 493 bp, Homo sapiens; identical to SEQ ID NO: 544666
  misc_feature: HIJSMM301DK1I2.12.23.C01.1.454.light.4.raw

SEQ ID NO: 574217 - DNA, 485 bp, Homo sapiens; identical to SEQ ID NO: 535609
  misc_feature: HIJSMM301CWE7O.46.35.D02.1.454.light.4.raw

SEQ ID NO: 574218 - DNA, 494 bp, Homo sapiens; identical to SEQ ID NO: 544470
  misc_feature: HIJSMM301E3E0R.40.54.E10.1.454.light.4.raw

SEQ ID NO: 574219 - DNA, 485 bp, Homo sapiens; identical to SEQ ID NO: 535606
  misc_feature: HIJSMM301DJK3G.47.46.E02.1.454.light.4.raw

SEQ ID NO: 574220 - DNA, 447 bp, Homo sapiens; identical to SEQ ID NO: 535201
  misc_feature: HIJSMM301D94I7.18.9.A09.1.454.light.4.raw

SEQ ID NO: 574221 - DNA, 447 bp, Homo sapiens; identical to SEQ ID NO: 535201
  misc_feature: HIJSMM301AJWP1.18.9.A09.1.454.light.4.raw

SEQ ID NO: 574222 - DNA, 493 bp, Homo sapiens; identical to SEQ ID NO: 535084
  misc_feature: HIJSMM301CCNVP.47.64.F09.1.454.light.4.raw

SEQ ID NO: 574223 - DNA, 495 bp, Homo sapiens; identical to SEQ ID NO: 542410
  misc_feature: HIJSMM301EVC3I.26.12.B01.1.454.light.4.raw

SEQ ID NO: 574224 - DNA, 488 bp, Homo sapiens; identical to SEQ ID NO: 535990
  misc_feature: HIJSMM301C9YDR.11.28.C06.1.454.light.4.raw

SEQ ID NO: 574225 - DNA, 487 bp, Homo sapiens; identical to SEQ ID NO: 536196
  misc_feature: HIJSMM301CMXE7.11.28.C06.1.454.light.4.raw

SEQ ID NO: 574226 - DNA, 482 bp, Homo sapiens
  misc_feature: HIJSMM301B3GVB.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgatttattattgccagtcctatgacaacaccctgcgtggttttggctgttcggcggcgggacc

SEQ ID NO: 574227 - DNA, 495 bp, Homo sapiens; identical to SEQ ID NO: 569639
  misc_feature: HIJSMM301EPZLV.10.20.B09.1.454.light.4.raw

SEQ ID NO: 574228 - DNA, 456 bp, Homo sapiens
  misc_feature: HIJSMM301AK98N.49.85.H08.1.454.light.4.raw
agtcgagagacacgaccggtgctcgatttagtatcactcagtcgcggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 574229 - DNA, 521 bp, Homo sapiens; identical to SEQ ID NO: 536990
  misc_feature: HIJSMM301ASTX4.27.23.C01.1.454.light.4.raw
  modified_base (517)..(517): a, c, t, g, unknown or other

SEQ ID NO: 574230 - DNA, 515 bp, Homo sapiens; identical to SEQ ID NO: 539211
  misc_feature: HIJSMM301BY19U.22.28.C06.1.454.light.4.raw

SEQ ID NO: 574231 - DNA, 491 bp, Homo sapiens
  misc_feature: HIJSMM301DVF3B.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggccaagggaccaaggtggaaatcaaccgaactgtggctgcaccatctgtt

SEQ ID NO: 574232 - DNA, 498 bp, Homo sapiens
  misc_feature: HIJSMM301DVBIW.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccgacggggaccgacggtcggagtgttcgaagcgaacgtagttggcgtgcaccatcttcg

SEQ ID NO: 574233 - DNA, 490 bp, Homo sapiens; identical to SEQ ID NO: 537951
  misc_feature: HIJSMM301D2GWQ.19.57.F02.1.454.light.4.raw

SEQ ID NO: 574234 - DNA, 504 bp, Homo sapiens; identical to SEQ ID NO: 535561
  misc_feature: HIJSMM301BDN8U.4.57.F02.1.454.light.4.raw

SEQ ID NO: 574235 - DNA, 505 bp, Homo sapiens
  misc_feature: HIJSMM301EO0RB.48.37.D04.1.454.light.4.raw
agtatacatacacgaccggtgctcgatttagtagcatactgttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 574236 - DNA, 500 bp, Homo sapiens
  misc_feature: HIJSMM301CJMB6.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccgctcactttcggcggagggaccaaggtggagatcaaacgaactgtggctgcaccatctgtcttcattcc

SEQ ID NO: 574237 - DNA, 505 bp, Homo sapiens
  misc_feature: HIJSMM301BKCDK.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccatgtca

SEQ ID NO: 574238 - DNA, 522 bp, Homo sapiens
  misc_feature: HIJSMM301CCGXU.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcctacttcgttcggacgggacggaacggacggaggagtacacgaacggaaccgtagttggtcggtcgtcgacccaacctacttcgttctttcctta

SEQ ID NO: 574239 - DNA, 503 bp, Homo sapiens
  misc_feature: HIJSMM301CM8PJ.19.67.G01.1.454.light.4.raw
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaaggctgaccgtcctaggtcagcccaaggctgccccctc

SEQ ID NO: 574240 - DNA, 499 bp, Homo sapiens; identical to SEQ ID NO: 537739
  misc_feature: HIJSMM301DBLIV.12.86.H09.1.454.light.4.raw

SEQ ID NO: 574241 - DNA, 494 bp, Homo sapiens; identical to SEQ ID NO: 536974
  misc_feature: HIJSMM301B232U.16.86.H09.1.454.light.4.raw

SEQ ID NO: 574242 - DNA, 514 bp, Homo sapiens
  misc_feature: HIJSMM301C3W1J.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgccgaacggaccgaacggtaggaagtacaagacgaactacgtggcgtcgcaccgatctgtcttctactcttcccgt

SEQ ID NO: 574243 - DNA, 468 bp, Homo sapiens
  misc_feature: HIJSMM301EU095.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattacccctcggaccgttcggccaggggaccaaagtggatgtcaaccgaa

SEQ ID NO: 574244 - DNA, 521 bp, Homo sapiens; identical to SEQ ID NO: 538715
  misc_feature: HIJSMM301E2JK3.27.23.C01.1.454.light.4.raw

SEQ ID NO: 574245 - DNA, 489 bp, Homo sapiens
  misc_feature: HIJSMM301EGSB4.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgccaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagaccccg

SEQ ID NO: 574246 - DNA, 491 bp, Homo sapiens; identical to SEQ ID NO: 543478
  misc_feature: HIJSMM301BEBCN.14.55.E11.1.454.light.4.raw

SEQ ID NO: 574247 - DNA, 494 bp, Homo sapiens; identical to SEQ ID NO: 534994
  misc_feature: HIJSMM301D1RLZ.27.78.H01.1.454.light.4.raw

SEQ ID NO: 574248 - DNA, 494 bp, Homo sapiens
  misc_feature: HIJSMM301EE4A1.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcgaccaagggaccaaggtggagatcaaacgaactgtggctgcaccat

SEQ ID NO: 574249 - DNA, 485 bp, Homo sapiens; identical to SEQ ID NO: 536576
  misc_feature: HIJSMM301EBYNB.46.35.D02.1.454.light.4.raw

SEQ ID NO: 574250 - DNA, 491 bp, Homo sapiens
  misc_feature: HIJSMM301CSDDS.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttgggttattactgcatgcaagctctacaaactccctcaacgttcggcggagggaccaaggtggagatcaaacgaactgtggctgcaccatctgtcttcta

SEQ ID NO: 574251 - DNA, 493 bp, Homo sapiens; identical to SEQ ID NO: 543949
  misc_feature: HIJSMM301A6PFR.16.68.G02.1.454.light.4.raw

SEQ ID NO: 574252 - DNA, 501 bp, Homo sapiens; identical to SEQ ID NO: 573468
  misc_feature: HIJSMM301C7IQR.4.39.D06.1.454.light.4.raw

SEQ ID NO: 574253 - DNA, 496 bp, Homo sapiens
  misc_feature: HIJSMM301EEOFJ.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctccggtcactctcgttcccgccctcctctgtcg

SEQ ID NO: 574254 - DNA, 505 bp, Homo sapiens
  misc_feature: HIJSMM301DWKPZ.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcaagagtactactttacctcaagtgatcaccttcggccaagggacacgactaggagattaaaacg

SEQ ID NO: 574255 - DNA, 485 bp, Homo sapiens; identical to SEQ ID NO: 536576
  misc_feature: HIJSMM301C7XGX.46.35.D02.1.454.light.4.raw

SEQ ID NO: 574256 - DNA, 483 bp, Homo sapiens
  misc_feature: HIJSMM301BXTQ0.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttcccgccatctgagctaacg

SEQ ID NO: 574257 - DNA, 501 bp, Homo sapiens; identical to SEQ ID NO: 536867
  misc_feature: HIJSMM301CZADW.5.86.H09.1.454.light.4.raw

SEQ ID NO: 574258 - DNA, 499 bp, Homo sapiens; identical to SEQ ID NO: 537739
  misc_feature: HIJSMM301DD5J5.12.86.H09.1.454.light.4.raw

SEQ ID NO: 574259 - DNA, 500 bp, Homo sapiens
  misc_feature: HIJSMM301EAYEV.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccgaacggtaggaaatacaaacgaaactagtggcgtgcaccaactctgtt

SEQ ID NO: 574260 - DNA, 501 bp, Homo sapiens
  misc_feature: HIJSMM301DSCYX.41.67.G01.1.454.light.4.raw
tctatactatcacgaccggtgctcgatttagagtatacatattgggtttgggggagtcagacccagtcaggacacagcatggacatgagggtccccgctcagctcctggggctcctgctgctctggctcccaggtgcgaaatgtgacatccagatgacccagtctccttccaccctgtctgcatttgtagtagacagagtcaccatcacttgccgggccagtcagagtcttagtaattggttggcctgctatcagcggaaaccggggaaagaccgtaacctcctcatgtctaacccatccactttagaaactggggccccatcaaggttcagcggccgtggatctgggacagaattcactctcaccatcagcagcctgcagcctgagaattttgcaaattgtcactaccaacagtttagttcttattcatattcggcggagggaccagggtcgaggtcaaacgaactgtggctgcaccatctgtcttcatcttcccgccat

SEQ ID NO: 574261 - DNA, 441 bp, Homo sapiens; identical to SEQ ID NO: 550529
  misc_feature: HIJSMM301DBAS1.41.9.A09.1.454.light.4.raw

SEQ ID NO: 574262 - DNA, 495 bp, Homo sapiens
  misc_feature: HIJSMM301B445X.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggccaggggaccaaggctggagatcaaacgaactgtggctgcaccatctgtcttcta

SEQ ID NO: 574263 - DNA, 501 bp, Homo sapiens
  misc_feature: HIJSMM301DF0AS.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgtcggtttattactgtctgcagtataataactggcctccacggtactacttttggccgaggggaccaagctggagatcaaacgaactgtggctgcaccatctgtt

SEQ ID NO: 574264 - DNA, 383 bp, Homo sapiens; identical to SEQ ID NO: 447524
  misc_feature: HIJSMM301EWB97.41.26.C04.1.454.light.4.raw

SEQ ID NO: 574265 - DNA, 490 bp, Homo sapiens; identical to SEQ ID NO: 535420
  misc_feature: HIJSMM301AHPO2.3.72.G06.1.454.light.4.raw

SEQ ID NO: 574266 - DNA, 503 bp, Homo sapiens; identical to SEQ ID NO: 537189
  misc_feature: HIJSMM301B5WP8.19.85.H08.1.454.light.4.raw

SEQ ID NO: 574267 - DNA, 508 bp, Homo sapiens
  misc_feature: HIJSMM301AL43O.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccacttcggccctcgggaccaaggtggagatacaaacgaactgtggctgcaccatctgtcttcta

SEQ ID NO: 574268 - DNA, 477 bp, Homo sapiens
  misc_feature: HIJSMM301BVH1A.19.77.G11.1.454.light.4.raw
tactctcgtgcacgaccggtgctcgatttagctagtcactcaagggaaagggtgacatccctcactgtggctcacgttcggcggagggaccgaggtggagatcaaacgtaagtgcactatccgaatgctttttgttataaggttttgatttggaggggttttgtgtttgagatatgaggtcaggtcaattccaaagagtaccagattctttcagaaagtcagatgagtaagggacagaaacttagttcatcttaaggaacagccaagcgctagccagttaagtgaggcatctcaattgcaagattttctctgcatcggtcaggttagtgatattaacagagaaaagagatttttgttaaggggaaagtaattaagctaacactgtggatcaccttcggccaagggacacgactggagattaaacgaactgtggctgcaccatctgtcttcatcttcccgccatctgacacgagagta

SEQ ID NO: 574269 - DNA, 490 bp, Homo sapiens
  misc_feature: HIJSMM301A2J6F.14.55.E11.1.454.light.4.raw
  modified_base (429)..(429): a, c, t, g, unknown or other
  modified_base (481)..(481): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatcccagatgacccagtcgtccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnacctttcggcggaggaccaaggcggagatcagacgaactgtggctgcaccanctgtctcta

SEQ ID NO: 574270 - DNA, 508 bp, Homo sapiens
  misc_feature: HIJSMM301BMGZZ.40.61.F06.1.454.light.4.raw
tctagcgactcacgaccggtgctcgatttagctacgctctaagggaaagggggagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggagggaccgaaggtggaggaatcaaacgaaactgtggctgcaccatctgtcttcatcttcccgcc

SEQ ID NO: 574271 - DNA, 484 bp, Homo sapiens
  misc_feature: HIJSMM301ARIX6.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggtccaaggaccgaaggtggaaagtacaaacgaaactagtgg

SEQ ID NO: 574272 - DNA, 464 bp, Homo sapiens
  misc_feature: HIJSMM301CPCRS.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattattgcagctcatatacaagcaccagcactctctatgtcttcggaactgggaccaaggtcaccgtcctaggtcagcccaaggccaaccccactgtcactctgttcccaccctcctccatactcgta

SEQ ID NO: 574273 - DNA, 505 bp, Homo sapiens
  misc_feature: HIJSMM301BA72J.48.38.D05.1.454.light.4.raw
agtatacatacacgaccggtgctcgatttagtatctgatagttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaaataaatagtcaatcgaactgtggctgcaccatctgtcttctatt

SEQ ID NO: 574274 - DNA, 499 bp, Homo sapiens; identical to SEQ ID NO: 551025
  misc_feature: HIJSMM301B6C3X.16.9.A09.1.454.light.4.raw

SEQ ID NO: 574275 - DNA, 492 bp, Homo sapiens; identical to SEQ ID NO: 541747
  misc_feature: HIJSMM301CSDG6.19.71.G05.1.454.light.4.raw

SEQ ID NO: 574276 - DNA, 497 bp, Homo sapiens
  misc_feature: HIJSMM301EL86Y.40.28.C06.1.454.light.4.raw
tctagcgactcacgaccggtgctcgatttagagctcacgtattgggtttggggagagaagagcttctcagttaggacccagagggaaccatggaaaccccagcgcagcttctcttcctcctgctactctggctcccagatgccaccggagaaattgtgttgacgcagtctccaggtaccctgtctttgtctccaggggaaagagccaccctctcctgcagggccagtcagagtattaggaacactgtccaaggctggtatcagcataaacctggccaggctcccaggctcctcatctatgagacgtccaggagggccagtggcatcccagacaggttcagtggcagtgggtctgggacagacttcactctcaccatcagcagcctagagcctgaagattttgcagtttattactgtcagcagcgtgccaactggcctctcactttcggcggagggaccaaggtggagatcaaacgaactgtggctgcaccatctgtt

SEQ ID NO: 574277 - DNA, 494 bp, Homo sapiens; identical to SEQ ID NO: 534992
  misc_feature: HIJSMM301CWHYK.9.1.A01.1.454.light.4.raw

SEQ ID NO: 574278 - DNA, 503 bp, Homo sapiens
  misc_feature: HIJSMM301CTCK9.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaaccccactgtcactctgttcccaccct

SEQ ID NO: 574279 - DNA, 498 bp, Homo sapiens
  misc_feature: HIJSMM301CG149.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgcccctcggtcactctgttcccaccctcctctgtcgagcgt

SEQ ID NO: 574280 - DNA, 522 bp, Homo sapiens
  misc_feature: HIJSMM301AZ7B7.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctccttcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgttggcagtttgggtgttcggcggagggaccaaactgaaccgtcctaggtcagccccaaggctgccccctcggtcacctcttccg

SEQ ID NO: 574281 - DNA, 491 bp, Homo sapiens
  misc_feature: HIJSMM301EAO75.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaac

SEQ ID NO: 574282 - DNA, 504 bp, Homo sapiens; identical to SEQ ID NO: 540636
  misc_feature: HIJSMM301CI28O.19.67.G01.1.454.light.4.raw

SEQ ID NO: 574283 - DNA, 468 bp, Homo sapiens
  misc_feature: HIJSMM301DP8CE.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcag

SEQ ID NO: 574284 - DNA, 517 bp, Homo sapiens
  misc_feature: HIJSMM301CY7ZI.51.55.E11.1.454.light.4.raw
cgatcgtatacacgaccggtgctcgatttagcactcgcacgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctgttccccg

SEQ ID NO: 574285 - DNA, 480 bp, Homo sapiens
  misc_feature: HIJSMM301EIQ6Y.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagcactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctacctccgagtggccactttttggcggggggaccgaacggttgggacagtcaaacgaac

SEQ ID NO: 574286 - DNA, 487 bp, Homo sapiens
  misc_feature: HIJSMM301AHB2G.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaaggaccgaaggtggaacgtcaacgaa

SEQ ID NO: 574287 - DNA, 501 bp, Homo sapiens; identical to SEQ ID NO: 535873
  misc_feature: HIJSMM301DH4C5.17.27.C05.1.454.light.4.raw

SEQ ID NO: 574288 - DNA, 485 bp, Homo sapiens; identical to SEQ ID NO: 541838
  misc_feature: HIJSMM301AO2CL.22.6.A06.1.454.light.4.raw

SEQ ID NO: 574289 - DNA, 464 bp, Homo sapiens
  misc_feature: HIJSMM301BUX7D.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctggagatattgcaacatattactgtcaacagtatgatcgtctcctcaatttcggccctgggaccaggagtggacatgaaacgaa

SEQ ID NO: 574290 - DNA, 507 bp, Homo sapiens; identical to SEQ ID NO: 542822
  misc_feature: HIJSMM301DAQGD.40.26.C04.1.454.light.4.raw

SEQ ID NO: 574291 - DNA, 497 bp, Homo sapiens; identical to SEQ ID NO: 535829
  misc_feature: HIJSMM301CJAQK.5.24.C02.1.454.light.4.raw

SEQ ID NO: 574292 - DNA, 488 bp, Homo sapiens; identical to SEQ ID NO: 537124
  misc_feature: HIJSMM301EMM7S.11.25.C03.1.454.light.4.raw

SEQ ID NO: 574293 - DNA, 516 bp, Homo sapiens
  misc_feature: HIJSMM301BNY3A.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaacggtaggaaagtacaaacgaaactagtggcgtgcaccactctcgtcttctactcttcccccg

SEQ ID NO: 574294 - DNA, 475 bp, Homo sapiens
  misc_feature: HIJSMM301C4MLD.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggtccaagggaccaaggtggaaatcaaacgaaa

SEQ ID NO: 574295 - DNA, 490 bp, Homo sapiens
  misc_feature: HIJSMM301A88OC.13.39.D06.1.454.light.4.raw
tcacgtactacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctgggctccaggctgaggatgagtctgattattactgctgctcatatgcaggcagctacactgtactattcggcggagggaccaagctgaccgtcctaggtcagaccccg

SEQ ID NO: 574296 - DNA, 495 bp, Homo sapiens
  misc_feature: HIJSMM301DFEBU.15.71.G05.1.454.light.4.raw
tctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggattttgcaacttactattgtcaacaggctaacagtttccctctcactttcggcggagggaccaaggtggatatcaaacgaactgtggctgcaccta

SEQ ID NO: 574297 - DNA, 482 bp, Homo sapiens; identical to SEQ ID NO: 541033
  misc_feature: HIJSMM301CMOBS.4.27.C05.1.454.light.4.raw

SEQ ID NO: 574298 - DNA, 497 bp, Homo sapiens; identical to SEQ ID NO: 535740
  misc_feature: HIJSMM301EUL70.3.71.G05.1.454.light.4.raw

SEQ ID NO: 574299 - DNA, 504 bp, Homo sapiens; identical to SEQ ID NO: 555965
  misc_feature: HIJSMM301AN2S6.48.36.D03.1.454.light.4.raw

SEQ ID NO: 574300 - DNA, 504 bp, Homo sapiens; identical to SEQ ID NO: 538940
  misc_feature: HIJSMM301BGLI0.2.35.D02.1.454.light.4.raw

SEQ ID NO: 574301 - DNA, 493 bp, Homo sapiens; identical to SEQ ID NO: 535770
  misc_feature: HIJSMM301C2JTC.51.71.G05.1.454.light.4.raw

SEQ ID NO: 574302 - DNA, 507 bp, Homo sapiens; identical to SEQ ID NO: 567373
  misc_feature: HIJSMM301DLBPH.47.83.H06.1.454.light.4.raw

SEQ ID NO: 574303 - DNA, 485 bp, Homo sapiens
  misc_feature: HIJSMM301CDMHT.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaacgaactgtggctgcaccatctgt

SEQ ID NO: 574304 - DNA, 499 bp, Homo sapiens
  misc_feature: HIJSMM301BRQZC.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggaggatacaaacgaactagtggcgtgcaccatctgtcttctat

SEQ ID NO: 574305 - DNA, 523 bp, Homo sapiens
  misc_feature: HIJSMM301DJ29X.49.34.D01.1.454.light.4.raw
agtcgagagacacgaccggtgctcgatttagatcgtctgtgttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcaggcggggcccagggtggaggatgaaggtgactactattgttactcaccagacaccagtgaaaatcacagaggaatattcggcggagggaccaagctgaccgtcctaggtcagcccaaggctcgccccctcggtcactctcgttcccgccctcct

SEQ ID NO: 574306 - DNA, 504 bp, Homo sapiens; identical to SEQ ID NO: 558529
  misc_feature: HIJSMM301DZYEP.41.35.D02.1.454.light.4.raw

SEQ ID NO: 574307 - DNA, 480 bp, Homo sapiens; identical to SEQ ID NO: 555208
  misc_feature: HIJSMM301CBZQ7.21.25.C03.1.454.light.4.raw

SEQ ID NO: 574308 - DNA, 509 bp, Homo sapiens; identical to SEQ ID NO: 539359
  misc_feature: HIJSMM301C29X5.47.85.H08.1.454.light.4.raw

SEQ ID NO: 574309 - DNA, 500 bp, Homo sapiens
  misc_feature: HIJSMM301DPO45.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccacttcggccctgggaccaaagtggagatcaaacgaactgtggctgcacca

SEQ ID NO: 574310 - DNA, 496 bp, Homo sapiens
  misc_feature: HIJSMM301AR7P2.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggacccaaggtggagtattcagacgaaactgtgg

SEQ ID NO: 574311 - DNA, 499 bp, Homo sapiens
  misc_feature: HIJSMM301EL00Z.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatgtcttcggaactggaccaaggtccaccgtcctaggtcacgcccaacgga

SEQ ID NO: 574312 - DNA, 502 bp, Homo sapiens
  misc_feature: HIJSMM301EU1RH.41.71.G05.1.454.light.4.raw
tctatactatcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactacctgatctataaggcgtctactttagtagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactagtggctgcaccatctgtcttcatcttccg

SEQ ID NO: 574313 - DNA, 495 bp, Homo sapiens; identical to SEQ ID NO: 555261
  misc_feature: HIJSMM301BUH7I.51.71.G05.1.454.light.4.raw

SEQ ID NO: 574314 - DNA, 511 bp, Homo sapiens
  misc_feature: HIJSMM301CU9ZI.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggtcaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccatc

SEQ ID NO: 574315 - DNA, 495 bp, Homo sapiens; identical to SEQ ID NO: 535486
  misc_feature: HIJSMM301AO969.26.72.G06.1.454.light.4.raw

SEQ ID NO: 574316 - DNA, 504 bp, Homo sapiens
  misc_feature: HIJSMM301BB70X.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccca

SEQ ID NO: 574317 - DNA, 495 bp, Homo sapiens
  misc_feature: HIJSMM301EU0ET.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcggtccaagggaccaaacgtggacatcaagcgaactacgtggcgtgcaccatctgtt

SEQ ID NO: 574318 - DNA, 495 bp, Homo sapiens; identical to SEQ ID NO: 535821
  misc_feature: HIJSMM301DT4WC.3.31.C09.1.454.light.4.raw

SEQ ID NO: 574319 - DNA, 506 bp, Homo sapiens
  misc_feature: HIJSMM301D4CKY.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccgggggccacttcggcccgtcgggaccaaaggtggagatcaaacgaactgtggctgcaccta

SEQ ID NO: 574320 - DNA, 509 bp, Homo sapiens
  misc_feature: HIJSMM301C1BL0.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccacctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccacctctca

SEQ ID NO: 574321 - DNA, 479 bp, Homo sapiens; identical to SEQ ID NO: 537163
  misc_feature: HIJSMM301D80VW.13.73.G07.1.454.light.4.raw

SEQ ID NO: 574322 - DNA, 487 bp, Homo sapiens
  misc_feature: HIJSMM301CDNRQ.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccacgttccggcggacggaccacagtcgacgatacaaacgaactgtggctgcaccat

SEQ ID NO: 574323 - DNA, 487 bp, Homo sapiens
  misc_feature: HIJSMM301EORFX.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 574324 - DNA, 474 bp, Homo sapiens
  misc_feature: HIJSMM301EE2AN.41.76.G10.1.454.light.4.raw
tctatactatcacgaccggtgctcgatttagtcactcatacagggggagtcagacccagtcaggacacagcatggacatgagggtccccgctcagctcctggggctcctgctgctctggctcccaggtgccaaatgtgacatcctgatgacccagtctccttccaccctgtctgcatctgtaggagacagagtcaccatcacttgtcgggccagtcagagtattagtggctggttggcctggtatcagcagacaccagggaaagcccctaagctcctgatccataaggcatctaatttagaaagtggggtcccatcaaggttcagcggcagtggatctgggacagaattcactctcaccatcagcagcctgcagcctgatgattttgcaacttattactgccagcaatatcatagttctccttggacgttcggccaggaccaaggtggacatcaaacgaactgtggctgcacca

SEQ ID NO: 574325 - DNA, 512 bp, Homo sapiens; identical to SEQ ID NO: 556539
  misc_feature: HIJSMM301DUVRQ.5.58.F03.1.454.light.4.raw

SEQ ID NO: 574326 - DNA, 527 bp, Homo sapiens
  misc_feature: HIJSMM301CNPIW.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtgggcctttcactttcgtcccggggacccggaaacgtaggaaagtacaacgaaactagtggcgtgcaccactactgtcttctactcttcccgtcccacct

SEQ ID NO: 574327 - DNA, 517 bp, Homo sapiens
  misc_feature: HIJSMM301CRNDG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaaggtaggaagtacgaaacgaactacgtggctgcaccactctgtcttctatcttcccgtccact

SEQ ID NO: 574328 - DNA, 496 bp, Homo sapiens; identical to SEQ ID NO: 563968
  misc_feature: HIJSMM301CIY4I.15.81.H04.1.454.light.4.raw

SEQ ID NO: 574329 - DNA, 492 bp, Homo sapiens; identical to SEQ ID NO: 540973
  misc_feature: HIJSMM301DA98P.43.20.B09.1.454.light.4.raw

SEQ ID NO: 574330 - DNA, 504 bp, Homo sapiens
  misc_feature: HIJSMM301E2ML4.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgatgctgattattactgcagctcatatgcaggcagcagcagtcccccatgtgatcttcggcggggggaccaaggctgaccgtcctaggtcagcccaaggctccg

SEQ ID NO: 574331 - DNA, 484 bp, Homo sapiens
  misc_feature: HIJSMM301CNZ8I.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcgagggaccaaggtggagatcaaacgaactgtggctgcaccatctgtcttcat

SEQ ID NO: 574332 - DNA, 516 bp, Homo sapiens
  misc_feature: HIJSMM301CA73G.48.73.G07.1.454.light.4.raw
agtatacatacacgaccggtgctcgatttagctctacgctcagggcacgaccggtgctcgatttagtacagatcgttagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatcccacccggaaatccggagttcctgacccgattccgtggcagcgggtctgggacagattttactctcaccatcagtagcctgcgggctgaagatgtggcagtttattactgtcaacaatattattatactccgccgacgtcggccggggaccgacgtacgtaaacg

SEQ ID NO: 574333 - DNA, 494 bp, Homo sapiens
  misc_feature: HIJSMM301C97QW.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggaggaccaaactgaccgtcttaggtcagcccaaggcct

SEQ ID NO: 574334 - DNA, 518 bp, Homo sapiens; identical to SEQ ID NO: 539372
  misc_feature: HIJSMM301BL7H8.7.86.H09.1.454.light.4.raw

SEQ ID NO: 574335 - DNA, 486 bp, Homo sapiens; identical to SEQ ID NO: 535385
  misc_feature: HIJSMM301C11SW.19.71.G05.1.454.light.4.raw

SEQ ID NO: 574336 - DNA, 504 bp, Homo sapiens; identical to SEQ ID NO: 535561
  misc_feature: HIJSMM301EM5EN.4.57.F02.1.454.light.4.raw

SEQ ID NO: 574337 - DNA, 504 bp, Homo sapiens
  misc_feature: HIJSMM301C08VW.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatggggctgattattattgcagctcatatgcaggcagttacaatgtgatattcggcggagggaccaaactgaccgtcctaggtcagcccaaggctgccccctggt

SEQ ID NO: 574338 - DNA, 504 bp, Homo sapiens; identical to SEQ ID NO: 538521
  misc_feature: HIJSMM301BAA33.9.12.B01.1.454.light.4.raw

SEQ ID NO: 574339 - DNA, 491 bp, Homo sapiens; identical to SEQ ID NO: 555285
  misc_feature: HIJSMM301AFQKJ.48.1.A01.1.454.light.4.raw

SEQ ID NO: 574340 - DNA, 487 bp, Homo sapiens; identical to SEQ ID NO: 545751
  misc_feature: HIJSMM301E3PJI.46.35.D02.1.454.light.4.raw

SEQ ID NO: 574341 - DNA, 489 bp, Homo sapiens; identical to SEQ ID NO: 535139
  misc_feature: HIJSMM301DYGAM.14.55.E11.1.454.light.4.raw

SEQ ID NO: 574342 - DNA, 488 bp, Homo sapiens
  misc_feature: HIJSMM301BEUR4.19.15.B04.1.454.light.4.raw
tactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaacgaactgtggctgcaccat

SEQ ID NO: 574343 - DNA, 490 bp, Homo sapiens; identical to SEQ ID NO: 538714
  misc_feature: HIJSMM301BNOOZ.11.12.B01.1.454.light.4.raw

SEQ ID NO: 574344 - DNA, 485 bp, Homo sapiens; identical to SEQ ID NO: 536576
  misc_feature: HIJSMM301CTUZF.46.35.D02.1.454.light.4.raw

SEQ ID NO: 574345 - DNA, 416 bp, Homo sapiens; identical to SEQ ID NO: 536892
  misc_feature: HIJSMM301ED1OH.16.46.E02.1.454.light.4.raw

SEQ ID NO: 574346 - DNA, 488 bp, Homo sapiens; identical to SEQ ID NO: 555641
  misc_feature: HIJSMM301DP9LQ.51.6.A06.1.454.light.4.raw

SEQ ID NO: 574347 - DNA, 480 bp, Homo sapiens; identical to SEQ ID NO: 553480
  misc_feature: HIJSMM301AROJP.21.25.C03.1.454.light.4.raw

SEQ ID NO: 574348 - DNA, 494 bp, Homo sapiens; identical to SEQ ID NO: 534994
  misc_feature: HIJSMM301AUZQP.27.78.H01.1.454.light.4.raw

SEQ ID NO: 574349 - DNA, 488 bp, Homo sapiens
  misc_feature: HIJSMM301AKQVF.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgttcttc

SEQ ID NO: 574350 - DNA, 487 bp, Homo sapiens; identical to SEQ ID NO: 538190
  misc_feature: HIJSMM301DXX4Q.47.70.G04.1.454.light.4.raw

SEQ ID NO: 574351 - DNA, 486 bp, Homo sapiens; identical to SEQ ID NO: 536323
  misc_feature: HIJSMM301B66Q4.10.2.A02.1.454.light.4.raw

SEQ ID NO: 574352 - DNA, 497 bp, Homo sapiens
  misc_feature: HIJSMM301DDOKL.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcgagtcgcgtct

SEQ ID NO: 574353 - DNA, 511 bp, Homo sapiens; identical to SEQ ID NO: 548439
  misc_feature: HIJSMM301ATI3A.16.46.E02.1.454.light.4.raw

SEQ ID NO: 574354 - DNA, 486 bp, Homo sapiens
  misc_feature: HIJSMM301AYTR8.52.53.E09.1.454.light.4.raw
  modified_base (400)..(400): a, c, t, g, unknown or other
  modified_base (437)..(437): a, c, t, g, unknown or other
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctcgtgggactgagcgctacctcaccatctccagcctcagtctgaggacgagggtnactattactgtcagacgtgggacactggcatttgggngttcgggcggagggaccaagttgaccgtctaggtcagcccaaggctccg

SEQ ID NO: 574355 - DNA, 502 bp, Homo sapiens
  misc_feature: HIJSMM301EX8TE.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggctttcggcgagggaccaagctgaccgtcctggtcagcccaaggctgccccctcggtcta

SEQ ID NO: 574356 - DNA, 506 bp, Homo sapiens; identical to SEQ ID NO: 542696
  misc_feature: HIJSMM301D3L5W.7.71.G05.1.454.light.4.raw

SEQ ID NO: 574357 - DNA, 444 bp, Homo sapiens; identical to SEQ ID NO: 535192
  misc_feature: HIJSMM301A1FD2.5.9.A09.1.454.light.4.raw

SEQ ID NO: 574358 - DNA, 508 bp, Homo sapiens; identical to SEQ ID NO: 560800
  misc_feature: HIJSMM301BJRNR.17.33.C11.1.454.light.4.raw

SEQ ID NO: 574359 - DNA, 496 bp, Homo sapiens; identical to SEQ ID NO: 537925
  misc_feature: HIJSMM301CH9XP.22.14.B03.1.454.light.4.raw

SEQ ID NO: 574360 - DNA, 486 bp, Homo sapiens
  misc_feature: HIJSMM301CPVMC.40.85.H08.1.454.light.4.raw
tctagcgactcacgaccggtgctcgatttagtatcactcagtcgcgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttgggctggtatcagcagaaaccagggagagcccctaagctcctcatctatgctgcatccactttacaaagtggagtcccatcaaggttcagcggcagtggatctggcacagatttcactctcaccatcagcagcctgcagcctgaagattttgcaacttattattgtctacacgactacagttaccctcggacgttcggtccaaggaccaacggtaggaaagtcaaacgaactacgtggctgcacctaa

SEQ ID NO: 574361 - DNA, 494 bp, Homo sapiens; identical to SEQ ID NO: 542031
  misc_feature: HIJSMM301B1EUG.12.23.C01.1.454.light.4.raw

SEQ ID NO: 574362 - DNA, 447 bp, Homo sapiens; identical to SEQ ID NO: 535020
  misc_feature: HIJSMM301CEV1H.18.9.A09.1.454.light.4.raw

SEQ ID NO: 574363 - DNA, 503 bp, Homo sapiens
  misc_feature: HIJSMM301A9QMX.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctggtcagcccaaggctgccccctcggtcta

SEQ ID NO: 574364 - DNA, 501 bp, Homo sapiens
  misc_feature: HIJSMM301ATZV2.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaa

SEQ ID NO: 574365 - DNA, 519 bp, Homo sapiens; identical to SEQ ID NO: 550353
  misc_feature: HIJSMM301CMUUX.5.27.C05.1.454.light.4.raw

SEQ ID NO: 574366 - DNA, 489 bp, Homo sapiens
  misc_feature: HIJSMM301EGB1S.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtcgtccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttca

SEQ ID NO: 574367 - DNA, 507 bp, Homo sapiens; identical to SEQ ID NO: 540930
  misc_feature: HIJSMM301BY2BM.8.34.D01.1.454.light.4.raw

SEQ ID NO: 574368 - DNA, 487 bp, Homo sapiens; identical to SEQ ID NO: 557252
  misc_feature: HIJSMM301DJ3QK.46.35.D02.1.454.light.4.raw

SEQ ID NO: 574369 - DNA, 520 bp, Homo sapiens; identical to SEQ ID NO: 535686
  misc_feature: HIJSMM301CU855.41.19.B08.1.454.light.4.raw

SEQ ID NO: 574370 - DNA, 443 bp, Homo sapiens; identical to SEQ ID NO: 548039
  misc_feature: HIJSMM301BWWPM.5.9.A09.1.454.light.4.raw

SEQ ID NO: 574371 - DNA, 501 bp, Homo sapiens
  misc_feature: HIJSMM301B50T8.48.57.F02.1.454.light.4.raw
agtatacatacacgaccggtgctcgatttagctcgatatagttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaataaatgtcaatcgaactgtggctgcaccatctgtcttcat

SEQ ID NO: 574372 - DNA, 496 bp, Homo sapiens
  misc_feature: HIJSMM301CQW7C.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatacaaacgaactgtggctgcaccatctgtctt

SEQ ID NO: 574373 - DNA, 496 bp, Homo sapiens
  misc_feature: HIJSMM301CQCNC.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtaactactttacctcaagtgatcaccttcggccaagggacacgactggagattaaacgaactagtggctgcaccatctgtctt

SEQ ID NO: 574374 - DNA, 511 bp, Homo sapiens
  misc_feature: HIJSMM301AP0AP.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggtttcaggctccctcctcgggggcaaagctgccctgacactgtcaggtgtgcagcctgaggacgaggctgactattactgcctgctcatatatggtggcgcgtgggtgttcggcggagggaccaagctgaccgtctgggtcagcccaaggctgccccctggtcactctgttcccaccct

SEQ ID NO: 574375 - DNA, 474 bp, Homo sapiens
  misc_feature: HIJSMM301BAPQI.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggtaccgaaggtggacatcaaacgaa

SEQ ID NO: 574376 - DNA, 504 bp, Homo sapiens; identical to SEQ ID NO: 573734
  misc_feature: HIJSMM301BSL3S.7.31.C09.1.454.light.4.raw

SEQ ID NO: 574377 - DNA, 383 bp, Homo sapiens; identical to SEQ ID NO: 447524
  misc_feature: HIJSMM301EI5XJ.41.26.C04.1.454.light.4.raw

SEQ ID NO: 574378 - DNA, 502 bp, Homo sapiens; identical to SEQ ID NO: 536253
  misc_feature: HIJSMM301DQG02.21.22.B11.1.454.light.4.raw

SEQ ID NO: 574379 - DNA, 496 bp, Homo sapiens
  misc_feature: HIJSMM301DOQUZ.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccagggaccgaaggtggagatacaaacgaactagtggctgcaccatctgtcttcatcttcccg

SEQ ID NO: 574380 - DNA, 467 bp, Homo sapiens
  misc_feature: HIJSMM301CCZ9B.43.71.G05.1.454.light.4.raw
tgtgagtagtcacgaccggtgctcgatttagtgtcgtcgcaagagagaggggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactactcaca

SEQ ID NO: 574381 - DNA, 442 bp, Homo sapiens
  misc_feature: HIJSMM301EMNAW.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtctaagtcagcccaaggctgccccctcggtcactctgttcccgccctcctcgtactagacg

SEQ ID NO: 574382 - DNA, 489 bp, Homo sapiens; identical to SEQ ID NO: 535139
  misc_feature: HIJSMM301AUTKT.14.55.E11.1.454.light.4.raw

SEQ ID NO: 574383 - DNA, 494 bp, Homo sapiens; identical to SEQ ID NO: 534994
  misc_feature: HIJSMM301AKRA7.27.78.H01.1.454.light.4.raw

SEQ ID NO: 574384 - DNA, 479 bp, Homo sapiens; identical to SEQ ID NO: 535118
  misc_feature: HIJSMM301DB1PB.13.59.F04.1.454.light.4.raw

SEQ ID NO: 574385 - DNA, 484 bp, Homo sapiens; identical to SEQ ID NO: 535400
  misc_feature: HIJSMM301DW0GM.46.26.C04.1.454.light.4.raw

SEQ ID NO: 574386 - DNA, 440 bp, Homo sapiens; identical to SEQ ID NO: 535667
  misc_feature: HIJSMM301ET5K7.41.9.A09.1.454.light.4.raw

SEQ ID NO: 574387 - DNA, 494 bp, Homo sapiens; identical to SEQ ID NO: 534992
  misc_feature: HIJSMM301AVWFT.9.1.A01.1.454.light.4.raw

SEQ ID NO: 574388 - DNA, 501 bp, Homo sapiens
  misc_feature: HIJSMM301CPA7E.53.28.C06.1.454.light.4.raw
cgcgtatacacacgaccggtgctcgatttagagctcacgtattgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtgggcccaggtggaggatgaagctgattactactgttactcaacagacaggagtggaaatcatagggtattcggcggagggaccaaactgaccgtcctaggtcagcccaaggctgccccctcggtctac

SEQ ID NO: 574389 - DNA, 497 bp, Homo sapiens
  misc_feature: HIJSMM301A1HNQ.49.66.F11.1.454.light.4.raw
  modified_base (483)..(483): a, c, t, g, unknown or other
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaaactgtggctgcaccaatctgtnttcctatcttcccg

SEQ ID NO: 574390 - DNA, 507 bp, Homo sapiens
  misc_feature: HIJSMM301BP5WI.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggagggctgaggatgttgggggtttattactgcatgcaaactacacacggccgctcactttcggcggagggaccgaaggtggagatcaaacgaactagtggctgcaccatct

SEQ ID NO: 574391 - DNA, 494 bp, Homo sapiens
  misc_feature: HIJSMM301EOVJ0.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatctcccgcc

SEQ ID NO: 574392 - DNA, 495 bp, Homo sapiens
  misc_feature: HIJSMM301EGW74.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaacccccactgtcactcc

SEQ ID NO: 574393 - DNA, 472 bp, Homo sapiens; identical to SEQ ID NO: 536302
  misc_feature: HIJSMM301DJTOD.18.76.G10.1.454.light.4.raw

SEQ ID NO: 574394 - DNA, 447 bp, Homo sapiens; identical to SEQ ID NO: 535020
  misc_feature: HIJSMM301D948H.18.9.A09.1.454.light.4.raw

SEQ ID NO: 574395 - DNA, 494 bp, Homo sapiens; identical to SEQ ID NO: 534992
  misc_feature: HIJSMM301BNXO6.9.1.A01.1.454.light.4.raw

SEQ ID NO: 574396 - DNA, 501 bp, Homo sapiens
  misc_feature: HIJSMM301C3O3J.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcgaagatgaggctgactattactgtaactcccgggacagcagtgctgaccaggtggtattcggcggacgggacccacctgaccgtctaggtcagcccaaggctgccccctcggtcac

SEQ ID NO: 574397 - DNA, 489 bp, Homo sapiens
  misc_feature: HIJSMM301CNF0B.3.33.C11.1.454.light.4.raw
agacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctg

SEQ ID NO: 574398 - DNA, 495 bp, Homo sapiens; identical to SEQ ID NO: 538920
  misc_feature: HIJSMM301CK4A1.47.64.F09.1.454.light.4.raw

SEQ ID NO: 574399 - DNA, 502 bp, Homo sapiens; identical to SEQ ID NO: 537363
  misc_feature: HIJSMM301DYKBI.18.23.C01.1.454.light.4.raw

SEQ ID NO: 574400 - DNA, 505 bp, Homo sapiens; identical to SEQ ID NO: 535503
  misc_feature: HIJSMM301AWYNF.8.28.C06.1.454.light.4.raw

SEQ ID NO: 574401 - DNA, 511 bp, Homo sapiens
  misc_feature: HIJSMM301CDM7T.16.46.E02.1.454.light.4.raw
tgtactactccacgaccggtgctcgatttagactcatctacaggggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctcg

SEQ ID NO: 574402 - DNA, 491 bp, Homo sapiens; identical to SEQ ID NO: 538021
  misc_feature: HIJSMM301DM9UG.3.72.G06.1.454.light.4.raw

SEQ ID NO: 574403 - DNA, 444 bp, Homo sapiens; identical to SEQ ID NO: 538511
  misc_feature: HIJSMM301B9NVJ.5.9.A09.1.454.light.4.raw
  modified_base (426)..(426): a, c, t, g, unknown or other

SEQ ID NO: 574404 - DNA, 517 bp, Homo sapiens
  misc_feature: HIJSMM301CNK8G.16.83.H06.1.454.light.4.raw
  modified_base (510)..(510): a, c, t, g, unknown or other
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcaggggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccnccctccc

SEQ ID NO: 574405 - DNA, 494 bp, Homo sapiens; identical to SEQ ID NO: 539894
  misc_feature: HIJSMM301CZ20B.16.53.E09.1.454.light.4.raw

SEQ ID NO: 574406 - DNA, 501 bp, Homo sapiens; identical to SEQ ID NO: 536142
  misc_feature: HIJSMM301CVL4Y.15.1.A01.1.454.light.4.raw

SEQ ID NO: 574407 - DNA, 502 bp, Homo sapiens
  misc_feature: HIJSMM301DJCA4.18.78.H01.1.454.light.4.raw
  modified_base (498)..(498): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactggaccaaggtcaccgtctagtcagccaaggccaacccnctgt

SEQ ID NO: 574408 - DNA, 494 bp, Homo sapiens
  misc_feature: HIJSMM301BOCT5.43.29.C07.1.454.light.4.raw
tgtgagtagtcacgaccggtgctcgatttagagtgctacgaagggaaaggggaggctggtcacacttcttgcaggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtgggtcccatcaagattcagcggtagtggatctgggacagaattcactctcaccgtcagcagcctgcagcctgaagattttgcaacttattactgtccaacagtttaataactaccctctcactttcggaggagggaccgagggtggagatacaaacgaact

SEQ ID NO: 574409 - DNA, 497 bp, Homo sapiens; identical to SEQ ID NO: 551988
  misc_feature: HIJSMM301D1JCS.52.35.D02.1.454.light.4.raw

SEQ ID NO: 574410 - DNA, 480 bp, Homo sapiens
  misc_feature: HIJSMM301CQYZ3.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacagtcccgctcactttcggcgagggaccaaggtgagatcaaagaa

SEQ ID NO: 574411 - DNA, 508 bp, Homo sapiens
  misc_feature: HIJSMM301CRYRY.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcaggtggcgtttgggtgttcggcggagggaccaagctgaccgttcg

SEQ ID NO: 574412 - DNA, 508 bp, Homo sapiens
  misc_feature: HIJSMM301CKCYP.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagccaagcgaactgtggctgcaccatctgtcttcatcttcccgcc

SEQ ID NO: 574413 - DNA, 496 bp, Homo sapiens; identical to SEQ ID NO: 538625
  misc_feature: HIJSMM301A1YFP.2.49.E05.1.454.light.4.raw

SEQ ID NO: 574414 - DNA, 500 bp, Homo sapiens; identical to SEQ ID NO: 552300
  misc_feature: HIJSMM301CH910.53.30.C08.1.454.light.4.raw

SEQ ID NO: 574415 - DNA, 494 bp, Homo sapiens; identical to SEQ ID NO: 534992
  misc_feature: HIJSMM301AGSJX.9.1.A01.1.454.light.4.raw

SEQ ID NO: 574416 - DNA, 492 bp, Homo sapiens; identical to SEQ ID NO: 559286
  misc_feature: HIJSMM301ENQVT.10.77.G11.1.454.light.4.raw

SEQ ID NO: 574417 - DNA, 504 bp, Homo sapiens
  misc_feature: HIJSMM301B9TQX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtggaaatcaaacgaactgtggctgcaccactctgtcttcatcttccccg

SEQ ID NO: 574418 - DNA, 509 bp, Homo sapiens; identical to SEQ ID NO: 535670
  misc_feature: HIJSMM301D7MFJ.47.23.C01.1.454.light.4.raw

SEQ ID NO: 574419 - DNA, 494 bp, Homo sapiens; identical to SEQ ID NO: 534994
  misc_feature: HIJSMM301CE1D9.27.78.H01.1.454.light.4.raw

SEQ ID NO: 574420 - DNA, 525 bp, Homo sapiens
  misc_feature: HIJSMM301AF13X.52.62.F07.1.454.light.4.raw
  modified_base (511)..(511): a, c, t, g, unknown or other
cgcagtacgacacgaccggtgctcgatttagtagtcgcataaagggaaaggggctgggcctaaggaagcagcactggtggtgcctcagccatggcctggaccgttctcctcctcggcctcctctctcactgcacaggctctgtggcctcctctgtggtgacacagccaccctcggtgtctgtggccccgggaaagacggcctcaataacctgtgagagagacaacattgaaagaagacatgtacactggtaccagctgaggcccggccaggcccccagattggtcctctataatgatgacgaccggccctcagggatccctgagcgcttttctggctccaattctgggaacacggctaccctgaccatcactagggtcgaagccggggacgaggccgactattactgtcaggtgtgggatagtaatactgatcaatatgtcttcggaactgggaccacggtcaccgtcctaagtcagcccaaggccaaccccactgtcactctgttccccnccctcctctatacg

SEQ ID NO: 574421 - DNA, 498 bp, Homo sapiens
  misc_feature: HIJSMM301A9J9G.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaagtttgctttctggtatcagcagaagccaggccagtcccctgtcttggtcatctataaggatagcaggcggccctcagggattcctgagcgattctccggctccaactccggcaacacagtcactctgaccatcagcgggacccaggctctcgatgaggctgactattactgccaggcgtgggacagctccacttcccgttatgtcttcggaggtgggaccatggtcaccgtcctaggtcagcccaagacccaacccactgt

SEQ ID NO: 574422 - DNA, 482 bp, Homo sapiens
  misc_feature: HIJSMM301CMA8L.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtgggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacca

SEQ ID NO: 574423 - DNA, 524 bp, Homo sapiens
  misc_feature: HIJSMM301CR57D.49.55.E11.1.454.light.4.raw
agtcgagagacacgaccggtgctcgatttagcactcgcacgttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcaggcggggcccaggtggaggatgaaggtgactactattgttactcaccagacaccagtagaaaatcacagaggaatattcggcggagggaccaagctgaccgtcctaggtcacgcccaaggctcgccccctcggtcactctcgttcccaccctcct

SEQ ID NO: 574424 - DNA, 479 bp, Homo sapiens
  misc_feature: HIJSMM301EJWHV.48.75.G09.1.454.light.4.raw
agtatacatacacgaccggtgctcgatttagtatagacatcaggggactgatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttctcccatacacttttggcccggggaccgaaggtggatctcaaaagaa

SEQ ID NO: 574425 - DNA, 521 bp, Homo sapiens; identical to SEQ ID NO: 539470
  misc_feature: HIJSMM301C091U.27.23.C01.1.454.light.4.raw

SEQ ID NO: 574426 - DNA, 487 bp, Homo sapiens
  misc_feature: HIJSMM301CNP4Z.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcacccat

SEQ ID NO: 574427 - DNA, 503 bp, Homo sapiens; identical to SEQ ID NO: 539976
  misc_feature: HIJSMM301BWPGK.47.55.E11.1.454.light.4.raw

SEQ ID NO: 574428 - DNA, 516 bp, Homo sapiens
  misc_feature: HIJSMM301DIO8O.41.33.C11.1.454.light.4.raw
tctatactatcacgaccggtgctcgatttagagtgagctcgttgggtttggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccgact

SEQ ID NO: 574429 - DNA, 489 bp, Homo sapiens
  misc_feature: HIJSMM301DDDQY.49.26.C04.1.454.light.4.raw
agtcgagagacacgaccggtgctcgatttagtctagcgactttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgtaacg

SEQ ID NO: 574430 - DNA, 503 bp, Homo sapiens; identical to SEQ ID NO: 538884
  misc_feature: HIJSMM301DMBNI.27.78.H01.1.454.light.4.raw

SEQ ID NO: 574431 - DNA, 511 bp, Homo sapiens; identical to SEQ ID NO: 537464
  misc_feature: HIJSMM301BYU3Q.7.34.D01.1.454.light.4.raw

SEQ ID NO: 574432 - DNA, 493 bp, Homo sapiens
  misc_feature: HIJSMM301A4GA9.48.28.C06.1.454.light.4.raw
  modified_base (448)..(448): a, c, t, g, unknown or other
agtatacatacacgaccggtgctcgatttagagctcacgtattgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtnttcggcagagggaccaagctgaccgtctaggtcagcccaaggctg

SEQ ID NO: 574433 - DNA, 487 bp, Homo sapiens; identical to SEQ ID NO: 539157
  misc_feature: HIJSMM301CDDAZ.26.37.D04.1.454.light.4.raw

SEQ ID NO: 574434 - DNA, 505 bp, Homo sapiens
  misc_feature: HIJSMM301A5Z4N.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccggactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaa

SEQ ID NO: 574435 - DNA, 507 bp, Homo sapiens
  misc_feature: HIJSMM301ASK61.8.28.C06.1.454.light.4.raw
ctcgcgtgtccacgaccggtgctcgatttagagctcacgtattgggtttggggggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttcactttcggcggagggaccaaggtggacctcaaacgaactgtggctgcaccatctgtcttcatcttcccgccat

SEQ ID NO: 574436 - DNA, 508 bp, Homo sapiens
  misc_feature: HIJSMM301D1MKV.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcgagggaccaagctgaccgtcttaagtcagcccaaggctgccccctcggtcactctgtcccg

SEQ ID NO: 574437 - DNA, 422 bp, Homo sapiens; identical to SEQ ID NO: 539229
  misc_feature: HIJSMM301CVIDL.41.15.B04.1.454.light.4.raw

SEQ ID NO: 574438 - DNA, 502 bp, Homo sapiens
  misc_feature: HIJSMM301DAOFS.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaacgaacgtgtggctgcaccatctgtcttcatcttccg

SEQ ID NO: 574439 - DNA, 447 bp, Homo sapiens; identical to SEQ ID NO: 535201
  misc_feature: HIJSMM301B31KI.18.9.A09.1.454.light.4.raw

SEQ ID NO: 574440 - DNA, 520 bp, Homo sapiens; identical to SEQ ID NO: 540293
  misc_feature: HIJSMM301BYE9R.27.23.C01.1.454.light.4.raw

SEQ ID NO: 574441 - DNA, 446 bp, Homo sapiens; identical to SEQ ID NO: 536034
  misc_feature: HIJSMM301DZ4IG.18.9.A09.1.454.light.4.raw

SEQ ID NO: 574442 - DNA, 503 bp, Homo sapiens
  misc_feature: HIJSMM301CRU3V.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtatttgtcggtttattactgtcagcagtataataactggcctccgacggtactacttttcggccgacgggaccaagtctggagatacaacgaactgtggctgcaccatctgtt

SEQ ID NO: 574443 - DNA, 482 bp, Homo sapiens; identical to SEQ ID NO: 535352
  misc_feature: HIJSMM301ARANI.16.81.H04.1.454.light.4.raw

SEQ ID NO: 574444 - DNA, 520 bp, Homo sapiens
  misc_feature: HIJSMM301CVQM7.43.23.C01.1.454.light.4.raw
  modified_base (440)..(440): a, c, t, g, unknown or other
tgtgagtagtcacgaccggtgctcgatttagtacacgtgattagggagttgggccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaagctgccctgacactgtcaggtgtgcagcctgaggacgaggctgactnttactgcctgctcatatatggtggcgcgtggggtgttcggcggagggaccaaggctggacccgtcctgggtcagcccaac

SEQ ID NO: 574445 - DNA, 494 bp, Homo sapiens; identical to SEQ ID NO: 558792
  misc_feature: HIJSMM301CQ2IA.10.79.H02.1.454.light.4.raw

SEQ ID NO: 574446 - DNA, 489 bp, Homo sapiens
  misc_feature: HIJSMM301AYAD7.4.4.A04.1.454.light.4.raw
  modified_base (468)..(468): a, c, t, g, unknown or other
  modified_base (479)..(479): a, c, t, g, unknown or other
agcactgtagcacgaccggtgctcgatttagagtagtgatcaggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgtcgggcaagtcagagtattaatagttggttggcctggtatcaccagagaccaggagaggccccaaggctccttatttatgatgcctccactgtgattagtggggtcccaccaacgttcagcggcagtggatctgggacatacttcactctcaccatcagcagcctgcagcctgatgatcttggaacttattactgccaaacagtataaatagtttttggacgttcggcagggacgaaggtacggaaatagagacgaactagnggctgcaccanctgtcttcta

SEQ ID NO: 574447 - DNA, 502 bp, Homo sapiens; identical to SEQ ID NO: 541971
  misc_feature: HIJSMM301EMEH6.4.39.D06.1.454.light.4.raw

SEQ ID NO: 574448 - DNA, 508 bp, Homo sapiens
  misc_feature: HIJSMM301CBO24.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacccaccttcttgaattggtttcagcagggaccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 574449 - DNA, 487 bp, Homo sapiens
  misc_feature: HIJSMM301DJV70.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattatgtcaacagggtaacagtttcccgctcaccttcggcggagggaccaaggtgagatgaaaagaactgtggctgcaccat

SEQ ID NO: 574450 - DNA, 496 bp, Homo sapiens
  misc_feature: HIJSMM301ANP0T.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctggggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgcc

SEQ ID NO: 574451 - DNA, 514 bp, Homo sapiens
  misc_feature: HIJSMM301B9LHE.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttggtgttcggcggaggaccatgctgaccgtcctgagtcagccaaggctgccccctcggtcactctgttcccgccct

SEQ ID NO: 574452 - DNA, 509 bp, Homo sapiens
  misc_feature: HIJSMM301DC8N3.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtccccccggacgttcggccacggggaccgacacgtagaaatgagacgaaacgtgtggctgcaccactctgtcttctatcttcccg

SEQ ID NO: 574453 - DNA, 481 bp, Homo sapiens; identical to SEQ ID NO: 542530
  misc_feature: HIJSMM301ET8L4.4.74.G08.1.454.light.4.raw

SEQ ID NO: 574454 - DNA, 508 bp, Homo sapiens
  misc_feature: HIJSMM301C2HWW.51.57.F02.1.454.light.4.raw
cgatcgtatacacgaccggtgctcgatttagctcgatatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcact

SEQ ID NO: 574455 - DNA, 477 bp, Homo sapiens
  misc_feature: HIJSMM301AOIKR.51.44.D11.1.454.light.4.raw
cgatcgtatacacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtctccattctccctgtctgcatctgtaggagacagagtcaccatcaattgccgggcaagtcagagcattagcaggtatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcaccat

SEQ ID NO: 574456 - DNA, 498 bp, Homo sapiens
  misc_feature: HIJSMM301DVHWE.51.49.E05.1.454.light.4.raw
cgatcgtatacacgaccggtgctcgatttagagcgactagcaacacacaaagggggaggaactgctcagttaggagccagacggaaccatggaagccccagcgcagcttctcttcctcctgctactctggctcccagataccattggagagatagtgctgacgcagtctccagccaccctgtctgtgtctccaggggagagagtcaccctctcctgcagggcctctgagaatatagatatctacttggtctggtaccagcaaaaacctggccagcctcccaggctcctcgtccatagtgcctccgccagggccgctggtgtcccagccaggttccgaggcagtcggtctgggacagagttcactctcaccattaccaacctgcagtctgaagattttggactttattactgtcagcagtataatgactggcctaggacgttcggccaagggaccaggtggaaatcaagacgaactgtggctgcaccatctgtcttcta

SEQ ID NO: 574457 - DNA, 377 bp, Homo sapiens; identical to SEQ ID NO: 536071
  misc_feature: HIJSMM301CQM4O.40.9.A09.1.454.light.4.raw

SEQ ID NO: 574458 - DNA, 489 bp, Homo sapiens; identical to SEQ ID NO: 535139
  misc_feature: HIJSMM301B55U3.14.55.E11.1.454.light.4.raw

SEQ ID NO: 574459 - DNA, 416 bp, Homo sapiens; identical to SEQ ID NO: 545902
  misc_feature: HIJSMM301E38GT.18.78.H01.1.454.light.4.raw

SEQ ID NO: 574460 - DNA, 454 bp, Homo sapiens
  misc_feature: HIJSMM301DCSGA.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggagagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 574461 - DNA, 472 bp, Homo sapiens; identical to SEQ ID NO: 562597
  misc_feature: HIJSMM301CK1IA.3.38.D05.1.454.light.4.raw

SEQ ID NO: 574462 - DNA, 511 bp, Homo sapiens
  misc_feature: HIJSMM301DUOWV.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaaccagcaacaattgggtgttcggcggagggaccaaactgaccgtcctaggtcagcccaaggctcgccccctcggtccactcttcg

SEQ ID NO: 574463 - DNA, 493 bp, Homo sapiens; identical to SEQ ID NO: 540418
  misc_feature: HIJSMM301BMKQ1.26.72.G06.1.454.light.4.raw

SEQ ID NO: 574464 - DNA, 494 bp, Homo sapiens
  misc_feature: HIJSMM301EK0D7.52.81.H04.1.454.light.4.raw
cgcagtacgacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcta

SEQ ID NO: 574465 - DNA, 499 bp, Homo sapiens; identical to SEQ ID NO: 572685
  misc_feature: HIJSMM301EQ3TL.15.25.C03.1.454.light.4.raw

SEQ ID NO: 574466 - DNA, 492 bp, Homo sapiens
  misc_feature: HIJSMM301A2U9N.40.32.C10.1.454.light.4.raw
  modified_base (480)..(480): a, c, t, g, unknown or other
tctagcgactcacgaccggtgctcgatttagtatagacatcaacacacaaagggggaggaactgctcagttaggacccagagggaaccatggaagccccagctcagcttctcttcctcctgctactctggctcccagttatcaccggagacattgtattgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcgccaggaccaaggtggacatcaagcgaactgtggctgnaccatctgtctt

SEQ ID NO: 574467 - DNA, 488 bp, Homo sapiens; identical to SEQ ID NO: 537124
  misc_feature: HIJSMM301CTXNO.11.25.C03.1.454.light.4.raw

SEQ ID NO: 574468 - DNA, 444 bp, Homo sapiens; identical to SEQ ID NO: 535411
  misc_feature: HIJSMM301DSRS9.8.73.G07.1.454.light.4.raw

SEQ ID NO: 574469 - DNA, 486 bp, Homo sapiens; identical to SEQ ID NO: 537617
  misc_feature: HIJSMM301CR713.10.53.E09.1.454.light.4.raw

SEQ ID NO: 574470 - DNA, 484 bp, Homo sapiens; identical to SEQ ID NO: 535400
  misc_feature: HIJSMM301BWEL9.46.26.C04.1.454.light.4.raw

SEQ ID NO: 574471 - DNA, 503 bp, Homo sapiens; identical to SEQ ID NO: 538256
  misc_feature: HIJSMM301EGVMG.19.67.G01.1.454.light.4.raw

SEQ ID NO: 574472 - DNA, 483 bp, Homo sapiens
  misc_feature: HIJSMM301DADUN.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaacgaactgtggctgcaccat

SEQ ID NO: 574473 - DNA, 508 bp, Homo sapiens
  misc_feature: HIJSMM301D9OCT.4.21.B10.1.454.light.4.raw
agcactgtagcacgaccggtgctcgatttagtgtcgtcgcaagagagagagagggaggggggggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaaccgaccctccgggatccctgagagattctctggctccagctcagggactatggccaccttgactatcagtgggcccaagtggaggatgaagctgactactactgttactcaatagagaacagtgataatttctgggtgttcggcgggaggaccaaactgaccgtcctaggtcagcccaaggctgccccctcggtcactc

SEQ ID NO: 574474 - DNA, 500 bp, Homo sapiens
  misc_feature: HIJSMM301BZ6YO.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccca

SEQ ID NO: 574475 - DNA, 484 bp, Homo sapiens; identical to SEQ ID NO: 535400
  misc_feature: HIJSMM301EIWFQ.46.26.C04.1.454.light.4.raw

SEQ ID NO: 574476 - DNA, 511 bp, Homo sapiens
  misc_feature: HIJSMM301BYBPV.9.37.D04.1.454.light.4.raw
tgatacgtctcacgaccggtgctcgatttagtagcatactgttgggtttgggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtgtgggggatacaacattggaagtaaaagtgttcactggtaccagcagaagccaggccaggccactgtgttggtcgtctatgatgatacagaccggccctcagggatccctgagcgattctctggctccaattctggtgacacggccaccctgatcatcagcagggtcgaggtcgaggatgaggccgactattactgtcaggtgtgggatagtggtactgatcattgggtgttcggcggagggaccaagctgaccgtcctaggtcagcccaaggctgccccctcggtcactctgttcccaccctcctcagacgtatcac

SEQ ID NO: 574477 - DNA, 487 bp, Homo sapiens
  misc_feature: HIJSMM301ECE7C.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatcccaggtcaggaagcacagcctccctgaccattactggactccaggctgacgacgaagctgattattactgctcagcatgggacaccggcctcagtgcggtgggttttcggcggagggaccaagctgaccgtcctaggtcagaccccg

SEQ ID NO: 574478 - DNA, 502 bp, Homo sapiens
  misc_feature: HIJSMM301BEWGB.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggcccaacccactgtca

SEQ ID NO: 574479 - DNA, 492 bp, Homo sapiens
  misc_feature: HIJSMM301CAM2X.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacttggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccggggaccaagctggaaatcaagcgaactgtggctgcaccatctgtcttcatt

SEQ ID NO: 574480 - DNA, 488 bp, Homo sapiens
  misc_feature: HIJSMM301EF9NR.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagac

SEQ ID NO: 574481 - DNA, 478 bp, Homo sapiens
  misc_feature: HIJSMM301EHTUK.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttgaagttattactgtcagacctatagtggtggcccgctcattttcggcggagggaccaaggtgcagatcaaacgaactgtgg

SEQ ID NO: 574482 - DNA, 377 bp, Homo sapiens; identical to SEQ ID NO: 536071
  misc_feature: HIJSMM301A09D5.40.9.A09.1.454.light.4.raw

SEQ ID NO: 574483 - DNA, 511 bp, Homo sapiens
  misc_feature: HIJSMM301C9LWI.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgttacgttttcggcggagggaccaagctgaccgtccgtgggtcacgacccaaggctcgccccctcggtccta

SEQ ID NO: 574484 - DNA, 503 bp, Homo sapiens; identical to SEQ ID NO: 542867
  misc_feature: HIJSMM301AS8EM.14.57.F02.1.454.light.4.raw

SEQ ID NO: 574485 - DNA, 486 bp, Homo sapiens; identical to SEQ ID NO: 535523
  misc_feature: HIJSMM301DP4PC.22.73.G07.1.454.light.4.raw

SEQ ID NO: 574486 - DNA, 497 bp, Homo sapiens
  misc_feature: HIJSMM301EBLDX.43.82.H05.1.454.light.4.raw
tgtgagtagtcacgaccggtgctcgatttagtcgagctctctcgcggggagcttcagctgtgggtagagaagacaggactcaggacaatctccagcatggccagcttccctctcctcctcgccctcctcactcactgtgcagggtcctgggcccagtctgtcctgactcagccaccctcagcgtctgggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattattgctgctcatatgcaggtagttacacttatgtcttcggaattgggacgacggtcaccgtcctaggtcagcccaaggccaa

SEQ ID NO: 574487 - DNA, 498 bp, Homo sapiens; identical to SEQ ID NO: 537020
  misc_feature: HIJSMM301D3Z00.26.26.C04.1.454.light.4.raw

SEQ ID NO: 574488 - DNA, 499 bp, Homo sapiens; identical to SEQ ID NO: 547044
  misc_feature: HIJSMM301AKMWS.43.71.G05.1.454.light.4.raw

SEQ ID NO: 574489 - DNA, 463 bp, Homo sapiens; identical to SEQ ID NO: 535062
  misc_feature: HIJSMM301B7VCI.11.73.G07.1.454.light.4.raw

SEQ ID NO: 574490 - DNA, 495 bp, Homo sapiens
  misc_feature: HIJSMM301D4EQ8.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtggtc

SEQ ID NO: 574491 - DNA, 494 bp, Homo sapiens; identical to SEQ ID NO: 534992
  misc_feature: HIJSMM301D30RN.9.1.A01.1.454.light.4.raw

SEQ ID NO: 574492 - DNA, 506 bp, Homo sapiens
  misc_feature: HIJSMM301C4LHG.14.57.F02.1.454.light.4.raw
cgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggggaccgaaggtggagttcaaacgaactgtggctgcaccatctgtcttcatcttcccgccta

SEQ ID NO: 574493 - DNA, 521 bp, Homo sapiens
  misc_feature: HIJSMM301CWSYP.9.12.B01.1.454.light.4.raw
  modified_base (491)..(491): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaacggaccgaaggtaggaaatacaaaacgaaacctagttagggctcgnaccaactctcgttcttcctattcttccccg

SEQ ID NO: 574494 - DNA, 496 bp, Homo sapiens
  misc_feature: HIJSMM301CNSAC.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttacccccggacgttcgtccacgggaccgaccggtggagtgtcgtagacgaactacgtggcgtgcgaccact

SEQ ID NO: 574495 - DNA, 383 bp, Homo sapiens; identical to SEQ ID NO: 548520
  misc_feature: HIJSMM301CG4P3.41.78.H01.1.454.light.4.raw

SEQ ID NO: 574496 - DNA, 508 bp, Homo sapiens; identical to SEQ ID NO: 561979
  misc_feature: HIJSMM301D23XR.47.85.H08.1.454.light.4.raw

SEQ ID NO: 574497 - DNA, 506 bp, Homo sapiens; identical to SEQ ID NO: 539926
  misc_feature: HIJSMM301B9ENO.5.24.C02.1.454.light.4.raw

SEQ ID NO: 574498 - DNA, 508 bp, Homo sapiens; identical to SEQ ID NO: 545298
  misc_feature: HIJSMM301BX7UF.8.42.D09.1.454.light.4.raw

SEQ ID NO: 574499 - DNA, 503 bp, Homo sapiens
  misc_feature: HIJSMM301EDI8N.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcactcaagtcttcggaactgggaccaaggtcaccgtcctaggtcagcccaaggccaacccactgtca

SEQ ID NO: 574500 - DNA, 482 bp, Homo sapiens; identical to SEQ ID NO: 537424
  misc_feature: HIJSMM301BFL3G.4.39.D06.1.454.light.4.raw

SEQ ID NO: 574501 - DNA, 479 bp, Homo sapiens
  misc_feature: HIJSMM301D7AU8.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttatattgtcagcaatattatacttctcttccgatcacttttggccaggggaccaggctggagatcagacgaa

SEQ ID NO: 574502 - DNA, 447 bp, Homo sapiens; identical to SEQ ID NO: 535882
  misc_feature: HIJSMM301A20JC.18.9.A09.1.454.light.4.raw
  modified_base (429)..(429): a, c, t, g, unknown or other

SEQ ID NO: 574503 - DNA, 501 bp, Homo sapiens; identical to SEQ ID NO: 542101
  misc_feature: HIJSMM301EY7RB.14.57.F02.1.454.light.4.raw

SEQ ID NO: 574504 - DNA, 497 bp, Homo sapiens
  misc_feature: HIJSMM301D5V9T.53.10.A10.1.454.light.4.raw
cgcgtatacacacgaccggtgctcgatttagcgtcgatctcagggggggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccgaaactgaccgtcctaggtcagcccaaggctgccccctcggtcactctgtccaccct

SEQ ID NO: 574505 - DNA, 494 bp, Homo sapiens; identical to SEQ ID NO: 534992
  misc_feature: HIJSMM301CYF94.9.1.A01.1.454.light.4.raw

SEQ ID NO: 574506 - DNA, 494 bp, Homo sapiens; identical to SEQ ID NO: 544718
  misc_feature: HIJSMM301BK1HW.47.64.F09.1.454.light.4.raw

SEQ ID NO: 574507 - DNA, 500 bp, Homo sapiens
  misc_feature: HIJSMM301EO9QV.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagtattttggaattttattactgtcaacagcgtagcaactggcctcccactttcggcggagggaccaaggtggagatcaagcgaactgtggctgcaccatctgtcttcatcttcccgcc

SEQ ID NO: 574508 - DNA, 507 bp, Homo sapiens; identical to SEQ ID NO: 535355
  misc_feature: HIJSMM301EFWPX.9.12.B01.1.454.light.4.raw

SEQ ID NO: 574509 - DNA, 511 bp, Homo sapiens; identical to SEQ ID NO: 544123
  misc_feature: HIJSMM301DHD8W.5.27.C05.1.454.light.4.raw

SEQ ID NO: 574510 - DNA, 505 bp, Homo sapiens
  misc_feature: HIJSMM301CKQFL.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccatgtcta

SEQ ID NO: 574511 - DNA, 504 bp, Homo sapiens
  misc_feature: HIJSMM301BJFVG.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatcgtgcctccgtactacctttggccgagggaccaagctggagatacaaacgaactgtggctgcaccatctgtcttcattcc

SEQ ID NO: 574512 - DNA, 483 bp, Homo sapiens
  misc_feature: HIJSMM301DUG9L.52.34.D01.1.454.light.4.raw
  modified_base (436)..(436): a, c, t, g, unknown or other
cgcagtacgacacgaccggtgctcgatttagatcgtctgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggngttcggcggagggaccaagttgaccgtctaggtcagcccaaggctcg

SEQ ID NO: 574513 - DNA, 510 bp, Homo sapiens
  misc_feature: HIJSMM301B3LRZ.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtccgaacgggaccgacgggtgggaaagtacaaacgaaactagtggcgtgcaccaactctgtcttctactt

SEQ ID NO: 574514 - DNA, 442 bp, Homo sapiens
  misc_feature: HIJSMM301CE935.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggccccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgcccctcggtcactctgttcccgcctcctccgtgtctgat

SEQ ID NO: 574515 - DNA, 493 bp, Homo sapiens
  misc_feature: HIJSMM301DQMEZ.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaactttagatgaggccgactattctgtcacacgtgggacatgggcactgcgatcttcggcggagggaccaagctgaccgtcctgggtcagcccaaggctcgccccctcggtcact

SEQ ID NO: 574516 - DNA, 493 bp, Homo sapiens; identical to SEQ ID NO: 536246
  misc_feature: HIJSMM301CV8JT.49.66.F11.1.454.light.4.raw

SEQ ID NO: 574517 - DNA, 497 bp, Homo sapiens; identical to SEQ ID NO: 536376
  misc_feature: HIJSMM301EAPZ0.22.9.A09.1.454.light.4.raw

SEQ ID NO: 574518 - DNA, 491 bp, Homo sapiens
  misc_feature: HIJSMM301CJ2KR.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgtttcggccaagggaccaaggtggatatcagacgaa

SEQ ID NO: 574519 - DNA, 491 bp, Homo sapiens; identical to SEQ ID NO: 535176
  misc_feature: HIJSMM301BRRWX.13.39.D06.1.454.light.4.raw

SEQ ID NO: 574520 - DNA, 510 bp, Homo sapiens
  misc_feature: HIJSMM301CTRWE.52.72.G06.1.454.light.4.raw
cgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctggtcactctcg

SEQ ID NO: 574521 - DNA, 493 bp, Homo sapiens
  misc_feature: HIJSMM301AFBM8.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatacttgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgtcttcta

SEQ ID NO: 574522 - DNA, 489 bp, Homo sapiens; identical to SEQ ID NO: 535139
  misc_feature: HIJSMM301BNZO1.14.55.E11.1.454.light.4.raw

SEQ ID NO: 574523 - DNA, 513 bp, Homo sapiens
  misc_feature: HIJSMM301A0576.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccacctcctcgctacgtaga

SEQ ID NO: 574524 - DNA, 500 bp, Homo sapiens
  misc_feature: HIJSMM301CSTS0.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttcgggtaacttttggtccgaggggaccgaagctggagatcagacgaacgtgtggctgcaccatctgtctt

SEQ ID NO: 574525 - DNA, 494 bp, Homo sapiens; identical to SEQ ID NO: 536974
  misc_feature: HIJSMM301AHKPC.16.86.H09.1.454.light.4.raw

SEQ ID NO: 574526 - DNA, 506 bp, Homo sapiens
  misc_feature: HIJSMM301AV3PQ.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaagtcagcgcaaggctgccccctcggtcactctgtt

SEQ ID NO: 574527 - DNA, 491 bp, Homo sapiens
  misc_feature: HIJSMM301CITGY.53.22.B11.1.454.light.4.raw
cgcgtatacacacgaccggtgctcgatttagacgacagctcagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagcccaaggccaacccactgtcactctcg

SEQ ID NO: 574528 - DNA, 491 bp, Homo sapiens
  misc_feature: HIJSMM301DQEX5.21.27.C05.1.454.light.4.raw
  modified_base (198)..(198): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgtcgcacgggaccaaggtggaatacaacgaactgtggctgcaccatctgtctt

SEQ ID NO: 574529 - DNA, 496 bp, Homo sapiens; identical to SEQ ID NO: 535541
  misc_feature: HIJSMM301D9RDV.3.33.C11.1.454.light.4.raw

SEQ ID NO: 574530 - DNA, 493 bp, Homo sapiens
  misc_feature: HIJSMM301BPVSN.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaaacgaactgtggctgcaccatctgtcttcatcttcccgccat

SEQ ID NO: 574531 - DNA, 507 bp, Homo sapiens
  misc_feature: HIJSMM301BSOAO.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcactactgtcgtttgggtgttcggcggagggaccaagttgaccgtcctaggtcagcccaaggctgccccctcggtcactctgtt

SEQ ID NO: 574532 - DNA, 475 bp, Homo sapiens
  misc_feature: HIJSMM301AD8Z3.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggactgggaccaaggtcaccgtcctaagtcagaccccg

SEQ ID NO: 574533 - DNA, 516 bp, Homo sapiens; identical to SEQ ID NO: 538293
  misc_feature: HIJSMM301CA666.14.19.B08.1.454.light.4.raw

SEQ ID NO: 574534 - DNA, 491 bp, Homo sapiens; identical to SEQ ID NO: 550287
  misc_feature: HIJSMM301BWSSE.14.36.D03.1.454.light.4.raw

SEQ ID NO: 574535 - DNA, 498 bp, Homo sapiens
  misc_feature: HIJSMM301A8JIQ.48.82.H05.1.454.light.4.raw
agtatacatacacgaccggtgctcgatttagtcgagctctctcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctgccccctc

SEQ ID NO: 574536 - DNA, 517 bp, Homo sapiens
  misc_feature: HIJSMM301BILM2.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcgggcggagggaccaaactgaccgtcctaggtcagcccaaggcctgccccctcggtcactctcg

SEQ ID NO: 574537 - DNA, 491 bp, Homo sapiens; identical to SEQ ID NO: 535294
  misc_feature: HIJSMM301AEASN.16.68.G02.1.454.light.4.raw

SEQ ID NO: 574538 - DNA, 486 bp, Homo sapiens; identical to SEQ ID NO: 536261
  misc_feature: HIJSMM301ESK2Q.26.55.E11.1.454.light.4.raw

SEQ ID NO: 574539 - DNA, 486 bp, Homo sapiens; identical to SEQ ID NO: 537238
  misc_feature: HIJSMM301BZS0P.19.71.G05.1.454.light.4.raw

SEQ ID NO: 574540 - DNA, 509 bp, Homo sapiens
  misc_feature: HIJSMM301C9CLB.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggcctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtccaggtcagcccaaggctgccccctcggtcact

SEQ ID NO: 574541 - DNA, 483 bp, Homo sapiens; identical to SEQ ID NO: 541990
  misc_feature: HIJSMM301D1YCE.46.26.C04.1.454.light.4.raw

SEQ ID NO: 574542 - DNA, 447 bp, Homo sapiens
  misc_feature: HIJSMM301EPI7M.18.9.A09.1.454.light.4.raw
  modified_base (308)..(308): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgnggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 574543 - DNA, 495 bp, Homo sapiens; identical to SEQ ID NO: 542571
  misc_feature: HIJSMM301CW463.7.59.F04.1.454.light.4.raw

SEQ ID NO: 574544 - DNA, 498 bp, Homo sapiens
  misc_feature: HIJSMM301AFA8P.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtccactctcgtt

SEQ ID NO: 574545 - DNA, 495 bp, Homo sapiens; identical to SEQ ID NO: 535712
  misc_feature: HIJSMM301AXV72.27.78.H01.1.454.light.4.raw

SEQ ID NO: 574546 - DNA, 504 bp, Homo sapiens
  misc_feature: HIJSMM301EBOOA.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcggcccaaggctgccccctc

SEQ ID NO: 574547 - DNA, 506 bp, Homo sapiens; identical to SEQ ID NO: 544106
  misc_feature: HIJSMM301DD30N.8.71.G05.1.454.light.4.raw

SEQ ID NO: 574548 - DNA, 494 bp, Homo sapiens; identical to SEQ ID NO: 534994
  misc_feature: HIJSMM301A8TPH.27.78.H01.1.454.light.4.raw

SEQ ID NO: 574549 - DNA, 494 bp, Homo sapiens; identical to SEQ ID NO: 534992
  misc_feature: HIJSMM301DOSLK.9.1.A01.1.454.light.4.raw

SEQ ID NO: 574550 - DNA, 486 bp, Homo sapiens; identical to SEQ ID NO: 535043
  misc_feature: HIJSMM301EKEIN.46.35.D02.1.454.light.4.raw

SEQ ID NO: 574551 - DNA, 488 bp, Homo sapiens
  misc_feature: HIJSMM301B8Z41.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaagaactgtggctgcaccat

SEQ ID NO: 574552 - DNA, 500 bp, Homo sapiens
  misc_feature: HIJSMM301D6VL9.48.28.C06.1.454.light.4.raw
agtatacatacacgaccggtgctcgatttagagctcacgtattgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggaggaccaagctgaccgtccaagtcagcccaaggctgccccctcggtcta

SEQ ID NO: 574553 - DNA, 447 bp, Homo sapiens; identical to SEQ ID NO: 535201
  misc_feature: HIJSMM301CRACD.18.9.A09.1.454.light.4.raw

SEQ ID NO: 574554 - DNA, 481 bp, Homo sapiens; identical to SEQ ID NO: 541494
  misc_feature: HIJSMM301ATZSG.51.76.G10.1.454.light.4.raw

SEQ ID NO: 574555 - DNA, 353 bp, Homo sapiens; identical to SEQ ID NO: 536338
  misc_feature: HIJSMM301EI3RB.3.11.A11.1.454.light.4.raw

SEQ ID NO: 574556 - DNA, 494 bp, Homo sapiens; identical to SEQ ID NO: 541035
  misc_feature: HIJSMM301AWGMS.26.12.B01.1.454.light.4.raw

SEQ ID NO: 574557 - DNA, 512 bp, Homo sapiens
  misc_feature: HIJSMM301ARN7P.17.33.C11.1.454.light.4.raw
cgtagactagcacgaccggtgctcgatttagagtgagctcgttgggtttggggtctggcccgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccca

SEQ ID NO: 574558 - DNA, 460 bp, Homo sapiens; identical to SEQ ID NO: 539553
  misc_feature: HIJSMM301DTIK2.11.86.H09.1.454.light.4.raw

SEQ ID NO: 574559 - DNA, 505 bp, Homo sapiens
  misc_feature: HIJSMM301D3NVF.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccctaaccccatgtca

SEQ ID NO: 574560 - DNA, 494 bp, Homo sapiens; identical to SEQ ID NO: 534992
  misc_feature: HIJSMM301AH3P4.9.1.A01.1.454.light.4.raw

SEQ ID NO: 574561 - DNA, 454 bp, Homo sapiens; identical to SEQ ID NO: 534964
  misc_feature: HIJSMM301CZRPI.19.86.H09.1.454.light.4.raw

SEQ ID NO: 574562 - DNA, 475 bp, Homo sapiens
  misc_feature: HIJSMM301DS0Z1.51.58.F03.1.454.light.4.raw
cgatcgtatacacgaccggtgctcgatttagtctgatcgagaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtgg

SEQ ID NO: 574563 - DNA, 522 bp, Homo sapiens
  misc_feature: HIJSMM301DWCGI.27.23.C01.1.454.light.4.raw
agcgtcgtctcacgaccggtgctcgatttagtacacgtgattagggattggggggggtctcaggaggcagcgctctcgggacgtctcctaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 574564 - DNA, 500 bp, Homo sapiens
  misc_feature: HIJSMM301AX67F.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaacgagccaccctctcctgcagggccagtcagagtattagcagcaacttagcctggtaccagcagaaacctggccaggctcccaggctcctcatctactggtgcatccaccagggccactggtatcccagccaggttcagtggcagtgggtctgggacagagttcactctcaccatcagcagcctgcagtctgaagattttgcggtttattactgtctgcagtataataactggcctccacggtacacttttggccgtaggggaccgaagctggagatcaacgaactgtggctgcaccatctgt

SEQ ID NO: 574565 - DNA, 498 bp, Homo sapiens
  misc_feature: HIJSMM301AW6K3.52.51.E07.1.454.light.4.raw
cgcagtacgacacgaccggtgctcgatttagcatactctacaacacacaaagggggagctacaacaggcaggcaggggcagcaagatggtgttgcagacccaggtcttcatttctctgttgctctggatctctggtgtctacggggacttcgtgctgacccagtctccagactccctggctgtgtctctgggcgcgagggccaccatcaactgcaagtccagccggagtgttttctggcgccccaccgataagaactacttagcttggtatcagcacaaaccaggacaccctcccaaactcctcatttcctgggcatctacccgggaatccggggtccctgaccgattcagtggcagcgggtctgagacggatttcactctcaccatcagcagcctgcaggctgaagatgtggcagtgtattactgtcagcagtatgctggtactccctacacttttggccagggaccaaggtggagatcaaacgaactgtggctgca

SEQ ID NO: 574566 - DNA, 492 bp, Homo sapiens; identical to SEQ ID NO: 573597
  misc_feature: HIJSMM301CMVDC.10.72.G06.1.454.light.4.raw

SEQ ID NO: 574567 - DNA, 501 bp, Homo sapiens; identical to SEQ ID NO: 574364
  misc_feature: HIJSMM301ALI2Q.18.59.F04.1.454.light.4.raw

SEQ ID NO: 574568 - DNA, 493 bp, Homo sapiens; identical to SEQ ID NO: 535047
  misc_feature: HIJSMM301CF6TJ.16.53.E09.1.454.light.4.raw

SEQ ID NO: 574569 - DNA, 506 bp, Homo sapiens; identical to SEQ ID NO: 534969
  misc_feature: HIJSMM301AQNQH.18.37.D04.1.454.light.4.raw

SEQ ID NO: 574570 - DNA, 478 bp, Homo sapiens; identical to SEQ ID NO: 535129
  misc_feature: HIJSMM301C85KI.11.11.A11.1.454.light.4.raw

SEQ ID NO: 574571 - DNA, 492 bp, Homo sapiens; identical to SEQ ID NO: 535126
  misc_feature: HIJSMM301D7SFM.18.11.A11.1.454.light.4.raw

SEQ ID NO: 574572 - DNA, 495 bp, Homo sapiens; identical to SEQ ID NO: 543094
  misc_feature: HIJSMM301CRSSB.22.57.F02.1.454.light.4.raw

SEQ ID NO: 574573 - DNA, 496 bp, Homo sapiens; identical to SEQ ID NO: 535109
  misc_feature: HIJSMM301BFUOP.16.78.H01.1.454.light.4.raw

SEQ ID NO: 574574 - DNA, 505 bp, Homo sapiens
  misc_feature: HIJSMM301DB8CJ.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaactacacacggccgctcactttcggcggagggaccaaggtggaggatcaaacgaactgtggctgcaccatctgt

SEQ ID NO: 574575 - DNA, 527 bp, Homo sapiens
  misc_feature: HIJSMM301BSGPM.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaagggaccgaacggtaggtaaggtacgaaacgaaccgtagtaggcgtcgcaccaactctgtcttctactcttcccgtcctact

SEQ ID NO: 574576 - DNA, 508 bp, Homo sapiens; identical to SEQ ID NO: 552440
  misc_feature: HIJSMM301BJYZP.5.24.C02.1.454.light.4.raw

SEQ ID NO: 574577 - DNA, 496 bp, Homo sapiens; identical to SEQ ID NO: 535423
  misc_feature: HIJSMM301DOG96.3.33.C11.1.454.light.4.raw

SEQ ID NO: 574578 - DNA, 500 bp, Homo sapiens; identical to SEQ ID NO: 539795
  misc_feature: HIJSMM301BH40N.22.38.D05.1.454.light.4.raw

SEQ ID NO: 574579 - DNA, 492 bp, Homo sapiens; identical to SEQ ID NO: 543155
  misc_feature: HIJSMM301ADNES.10.53.E09.1.454.light.4.raw

SEQ ID NO: 574580 - DNA, 485 bp, Homo sapiens; identical to SEQ ID NO: 536799
  misc_feature: HIJSMM301A8C2K.19.71.G05.1.454.light.4.raw

SEQ ID NO: 574581 - DNA, 491 bp, Homo sapiens; identical to SEQ ID NO: 536211
  misc_feature: HIJSMM301B77YJ.16.53.E09.1.454.light.4.raw

SEQ ID NO: 574582 - DNA, 516 bp, Homo sapiens; identical to SEQ ID NO: 552129
  misc_feature: HIJSMM301AKTP5.27.23.C01.1.454.light.4.raw

SEQ ID NO: 574583 - DNA, 491 bp, Homo sapiens; identical to SEQ ID NO: 544461
  misc_feature: HIJSMM301B47RO.47.36.D03.1.454.light.4.raw

SEQ ID NO: 574584 - DNA, 495 bp, Homo sapiens
  misc_feature: HIJSMM301DN2I7.16.49.E05.1.454.light.4.raw
  modified_base (471)..(471): a, c, t, g, unknown or other
tgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtnaccgtcctaggtcagcccaaggct

SEQ ID NO: 574585 - DNA, 494 bp, Homo sapiens; identical to SEQ ID NO: 534992
  misc_feature: HIJSMM301AN31A.9.1.A01.1.454.light.4.raw

SEQ ID NO: 574586 - DNA, 503 bp, Homo sapiens; identical to SEQ ID NO: 542867
  misc_feature: HIJSMM301BYP64.14.57.F02.1.454.light.4.raw

SEQ ID NO: 574587 - DNA, 517 bp, Homo sapiens; identical to SEQ ID NO: 536980
  misc_feature: HIJSMM301CZDMV.5.27.C05.1.454.light.4.raw

SEQ ID NO: 574588 - DNA, 494 bp, Homo sapiens; identical to SEQ ID NO: 559941
  misc_feature: HIJSMM301CXEDI.16.68.G02.1.454.light.4.raw

SEQ ID NO: 574589 - DNA, 486 bp, Homo sapiens; identical to SEQ ID NO: 535043
  misc_feature: HIJSMM301ERNOD.46.35.D02.1.454.light.4.raw

SEQ ID NO: 574590 - DNA, 491 bp, Homo sapiens
  misc_feature: HIJSMM301BMGVX.49.52.E08.1.454.light.4.raw
agtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccact

SEQ ID NO: 574591 - DNA, 454 bp, Homo sapiens; identical to SEQ ID NO: 535005
  misc_feature: HIJSMM301BM0LZ.19.86.H09.1.454.light.4.raw

SEQ ID NO: 574592 - DNA, 531 bp, Homo sapiens
  misc_feature: HIJSMM301CH8FN.8.23.C01.1.454.light.4.raw
  modified_base (493)..(493): a, c, t, g, unknown or other
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaaagcccaagccggtgatgaggctgactatttttgtcaggtgtgggacagcagcatttatgtcttcggacctgggaccaaggtcaccgtcctaggtcgaccgaccgacgaccccaacccnctcgtccactcgttccgtccccgtcccctctaccgacg

SEQ ID NO: 574593 - DNA, 506 bp, Homo sapiens; identical to SEQ ID NO: 557854
  misc_feature: HIJSMM301CZLDE.7.71.G05.1.454.light.4.raw

SEQ ID NO: 574594 - DNA, 515 bp, Homo sapiens
  misc_feature: HIJSMM301AW2DQ.9.12.B01.1.454.light.4.raw
  modified_base (497)..(497): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggtcgttcggtccgaacgggaccgaacggtaggaaagtacaaacgaacgtagtggcgtgcgaccanctgtcttcatcttccccg

SEQ ID NO: 574595 - DNA, 486 bp, Homo sapiens; identical to SEQ ID NO: 535043
  misc_feature: HIJSMM301BDKGI.46.35.D02.1.454.light.4.raw

SEQ ID NO: 574596 - DNA, 492 bp, Homo sapiens; identical to SEQ ID NO: 541650
  misc_feature: HIJSMM301BQX9Q.5.57.F02.1.454.light.4.raw

SEQ ID NO: 574597 - DNA, 486 bp, Homo sapiens; identical to SEQ ID NO: 535043
  misc_feature: HIJSMM301DU9ZV.46.35.D02.1.454.light.4.raw

SEQ ID NO: 574598 - DNA, 514 bp, Homo sapiens
  misc_feature: HIJSMM301DDVC7.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccacggacgaacggtaggaagtcaagcgaactgtggctgcaccatctgtcttctatcttcccgtccact

SEQ ID NO: 574599 - DNA, 491 bp, Homo sapiens
  misc_feature: HIJSMM301CNWRZ.43.78.H01.1.454.light.4.raw
  modified_base (363)..(363): a, c, t, g, unknown or other
tgtgagtagtcacgaccggtgctcgatttagtgtgagtagtttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagatttttcnctcgtcatcactggtctacagtctgacgacggcgcaatgtacttctgtcaacactatgcctctcccccctacaatttcggtcaggggaccaagttgaacatcaatcgaactgtggctgcaccatctgt

SEQ ID NO: 574600 - DNA, 491 bp, Homo sapiens; identical to SEQ ID NO: 540256
  misc_feature: HIJSMM301DQG4N.46.67.G01.1.454.light.4.raw

SEQ ID NO: 574601 - DNA, 488 bp, Homo sapiens; identical to SEQ ID NO: 537055
  misc_feature: HIJSMM301B8B8N.4.64.F09.1.454.light.4.raw

SEQ ID NO: 574602 - DNA, 504 bp, Homo sapiens
  misc_feature: HIJSMM301ANYVX.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtctaagtcagcccaaggccaacccactgtcactctgttcccacccct

SEQ ID NO: 574603 - DNA, 510 bp, Homo sapiens
  misc_feature: HIJSMM301CDDHE.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacgacctccctgaccatctctgggctccaggctgaggacgaggctgattattactgcagcttatatacaggcaacaatacttttgtcttcggaactgggaccaaggtcaccgtcctaggtcagcccaaggccaacccactgtcactctcg

SEQ ID NO: 574604 - DNA, 512 bp, Homo sapiens
  misc_feature: HIJSMM301E1BUV.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactcgtcactctgttcccgccctcctccgtgtctgat

SEQ ID NO: 574605 - DNA, 499 bp, Homo sapiens
  misc_feature: HIJSMM301B3T8D.48.45.E01.1.454.light.4.raw
agtatacatacacgaccggtgctcgatttagtgagtcagtaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagactttttagtttacgtcggaccttggccaagggacacgactggagattaaacgaactgtggctgcaccatctgtcttcatcttcccg

SEQ ID NO: 574606 - DNA, 500 bp, Homo sapiens
  misc_feature: HIJSMM301BHKV6.49.69.G03.1.454.light.4.raw
agtcgagagacacgaccggtgctcgatttagtcgctgcgtaaaggagaaagggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagccaggttcagtggcagtgggtctgggacagacttcactctcaccatcagcagcttagagcctgaagattttgcagtttattactgtcagcagcgtatcaccgggatcaccttcggccaagggaccgactggagattaagcgaactgtggctgcaccatctgtcttcatcttcccg

SEQ ID NO: 574607 - DNA, 504 bp, Homo sapiens
  misc_feature: HIJSMM301B4K11.9.65.F10.1.454.light.4.raw
tgatacgtctcacgaccggtgctcgatttagctacgctctaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttctgactctgtctcctggtaccaacaacacccaggcaaaccccccaagctcatgatttatgatgtcaatcatcggccctcaggggtttctgatcgcttctctggctccaagtccggcaacacggcctccctgaccgtctctgggctccagactgacgacgaggctgattatttctgctcctcatatacaaggggcagcactctcgtactattcggcggagggaccaagctgaccgtcctgggtcagcccaaggctgccccctcggtcact

SEQ ID NO: 574608 - DNA, 502 bp, Homo sapiens
  misc_feature: HIJSMM301BTDO5.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggcccaaccccactcgtcactctcgttcccgccctcctcgtatctctcg

SEQ ID NO: 574609 - DNA, 494 bp, Homo sapiens; identical to SEQ ID NO: 534992
  misc_feature: HIJSMM301B03QI.9.1.A01.1.454.light.4.raw

SEQ ID NO: 574610 - DNA, 432 bp, Homo sapiens; identical to SEQ ID NO: 535811
  misc_feature: HIJSMM301B4YGO.14.5.A05.1.454.light.4.raw

SEQ ID NO: 574611 - DNA, 491 bp, Homo sapiens; identical to SEQ ID NO: 535176
  misc_feature: HIJSMM301A8NCR.13.39.D06.1.454.light.4.raw

SEQ ID NO: 574612 - DNA, 521 bp, Homo sapiens; identical to SEQ ID NO: 539470
  misc_feature: HIJSMM301BTTL4.27.23.C01.1.454.light.4.raw

SEQ ID NO: 574613 - DNA, 486 bp, Homo sapiens; identical to SEQ ID NO: 535043
  misc_feature: HIJSMM301CHLE8.46.35.D02.1.454.light.4.raw

SEQ ID NO: 574614 - DNA, 492 bp, Homo sapiens; identical to SEQ ID NO: 535126
  misc_feature: HIJSMM301EPE2H.18.11.A11.1.454.light.4.raw

SEQ ID NO: 574615 - DNA, 496 bp, Homo sapiens
  misc_feature: HIJSMM301B2836.4.33.C11.1.454.light.4.raw
agcactgtagcacgaccggtgctcgatttagagtgagctcgttggggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcgagctacccgggaatccggggtccctgagcgattcagtggcagcgggtctgggacagatttcactctcaccatcagcagcctgcaggctgaagatgtggcagttattactgtcagcaatatctactactcctcggacttcggtcggacgggacgaacggtaggaggagtacaacaacgtacg

SEQ ID NO: 574616 - DNA, 470 bp, Homo sapiens
  misc_feature: HIJSMM301ADUN6.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggacgaagtggacatcaaacgaa

SEQ ID NO: 574617 - DNA, 489 bp, Homo sapiens; identical to SEQ ID NO: 536663
  misc_feature: HIJSMM301B1B7G.16.72.G06.1.454.light.4.raw

SEQ ID NO: 574618 - DNA, 516 bp, Homo sapiens
  misc_feature: HIJSMM301CNCE9.10.86.H09.1.454.light.4.raw
catagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccgccctcctccactactatg

SEQ ID NO: 574619 - DNA, 444 bp, Homo sapiens; identical to SEQ ID NO: 535042
  misc_feature: HIJSMM301D215P.10.76.G10.1.454.light.4.raw

SEQ ID NO: 574620 - DNA, 512 bp, Homo sapiens; identical to SEQ ID NO: 568870
  misc_feature: HIJSMM301CTQ4G.8.39.D06.1.454.light.4.raw

SEQ ID NO: 574621 - DNA, 505 bp, Homo sapiens
  misc_feature: HIJSMM301DMEC1.13.73.G07.1.454.light.4.raw
tcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcacgtcctggtcagcccaaggccaacccactgtcactctgttcc

SEQ ID NO: 574622 - DNA, 505 bp, Homo sapiens
  misc_feature: HIJSMM301EJVBI.47.85.H08.1.454.light.4.raw
agctcacgtacacgaccggtgctcgatttagtatcactcagtcgcgggggctggggtctcaggaggcagcgctctcaggacatctccaccatgacctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttggcaactactgtcgtttgggtgttcggcggagggaccaagttgaccgtcctaggtcagcccaaggctgccccctggtcactc

SEQ ID NO: 574623 - DNA, 495 bp, Homo sapiens; identical to SEQ ID NO: 538651
  misc_feature: HIJSMM301BVKBU.10.79.H02.1.454.light.4.raw

SEQ ID NO: 574624 - DNA, 473 bp, Homo sapiens
  misc_feature: HIJSMM301CO3KB.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtactcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttcccgccat

SEQ ID NO: 574625 - DNA, 505 bp, Homo sapiens; identical to SEQ ID NO: 535503
  misc_feature: HIJSMM301DHTLR.8.28.C06.1.454.light.4.raw

SEQ ID NO: 574626 - DNA, 497 bp, Homo sapiens
  misc_feature: HIJSMM301B1BCJ.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctactcatatgcaggcggcaactcttgggtgttcggcggagggaccaagctgaccgtcctaggtcagcccaaggctcgccccctcggtcactctcgttcccaccctcctcacgtcg

SEQ ID NO: 574627 - DNA, 490 bp, Homo sapiens
  misc_feature: HIJSMM301ATN23.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttctaccatcatcaacctgcagcctgaggatattgcaacatattactgtcaacaatatgataatctaccactcactttcggtcggagggaccgacggtggaggatcaaacgaactagtggctgcaccatctgtt

SEQ ID NO: 574628 - DNA, 486 bp, Homo sapiens; identical to SEQ ID NO: 535043
  misc_feature: HIJSMM301A7YCH.46.35.D02.1.454.light.4.raw

SEQ ID NO: 574629 - DNA, 484 bp, Homo sapiens; identical to SEQ ID NO: 535400
  misc_feature: HIJSMM301CT91P.46.26.C04.1.454.light.4.raw

SEQ ID NO: 574630 - DNA, 449 bp, Homo sapiens
  misc_feature: HIJSMM301A8WGT.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttccccgccctcctccatactcgta

SEQ ID NO: 574631 - DNA, 512 bp, Homo sapiens; identical to SEQ ID NO: 537325
  misc_feature: HIJSMM301BPXLH.48.86.H09.1.454.light.4.raw

SEQ ID NO: 574632 - DNA, 486 bp, Homo sapiens; identical to SEQ ID NO: 535523
  misc_feature: HIJSMM301DRUIT.22.73.G07.1.454.light.4.raw

SEQ ID NO: 574633 - DNA, 500 bp, Homo sapiens
  misc_feature: HIJSMM301DLI8J.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacgaactgtgctgcaccatctgtcttcatcttccccg

SEQ ID NO: 574634 - DNA, 496 bp, Homo sapiens; identical to SEQ ID NO: 535109
  misc_feature: HIJSMM301B4U1E.16.78.H01.1.454.light.4.raw

SEQ ID NO: 574635 - DNA, 484 bp, Homo sapiens; identical to SEQ ID NO: 535400
  misc_feature: HIJSMM301BPAMM.46.26.C04.1.454.light.4.raw

SEQ ID NO: 574636 - DNA, 506 bp, Homo sapiens
  misc_feature: HIJSMM301BDTRK.48.15.B04.1.454.light.4.raw
agtatacatacacgaccggtgctcgatttagacagtatatatccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccggggaccaacgtggaaatcaaacgaactgtggctgcaccatctgtcttcta

SEQ ID NO: 574637 - DNA, 506 bp, Homo sapiens; identical to SEQ ID NO: 534969
  misc_feature: HIJSMM301CT9QG.18.37.D04.1.454.light.4.raw

SEQ ID NO: 574638 - DNA, 520 bp, Homo sapiens; identical to SEQ ID NO: 537173
  misc_feature: HIJSMM301C2OLS.27.23.C01.1.454.light.4.raw

SEQ ID NO: 574639 - DNA, 486 bp, Homo sapiens; identical to SEQ ID NO: 535043
  misc_feature: HIJSMM301C78GE.46.35.D02.1.454.light.4.raw

SEQ ID NO: 574640 - DNA, 520 bp, Homo sapiens; identical to SEQ ID NO: 539176
  misc_feature: HIJSMM301CZ6R2.27.23.C01.1.454.light.4.raw

SEQ ID NO: 574641 - DNA, 494 bp, Homo sapiens
  misc_feature: HIJSMM301BG7SJ.5.24.C02.1.454.light.4.raw
atcagacacgcacgaccggtgctcgatttagtacagatcgttagggaaaggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcgcggggggaccaagctgaccgtcctaggtcagccc

SEQ ID NO: 574642 - DNA, 504 bp, Homo sapiens
  misc_feature: HIJSMM301BMHTJ.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaaccttcggccgagggacacgcctggagattaaacgaactgtggctgcaccatctgtt

SEQ ID NO: 574643 - DNA, 487 bp, Homo sapiens; identical to SEQ ID NO: 551272
  misc_feature: HIJSMM301DKQII.4.59.F04.1.454.light.4.raw

SEQ ID NO: 574644 - DNA, 497 bp, Homo sapiens
  misc_feature: HIJSMM301ECYXU.19.71.G05.1.454.light.4.raw
tactctcgtgcacgaccggtgctcgatttagtgtcgtcgcaagagagaggggggaggtacaacaggcaggcaggggcagaaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaagggaccaaggtggatatcagacgaaactgtggctgca

SEQ ID NO: 574645 - DNA, 509 bp, Homo sapiens; identical to SEQ ID NO: 535670
  misc_feature: HIJSMM301DNGXV.47.23.C01.1.454.light.4.raw

SEQ ID NO: 574646 - DNA, 503 bp, Homo sapiens
  misc_feature: HIJSMM301EAS2G.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcta

SEQ ID NO: 574647 - DNA, 444 bp, Homo sapiens
  misc_feature: HIJSMM301CFOH1.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcgggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccctcctcagacgtatca

SEQ ID NO: 574648 - DNA, 487 bp, Homo sapiens; identical to SEQ ID NO: 567185
  misc_feature: HIJSMM301CD2S9.14.55.E11.1.454.light.4.raw

SEQ ID NO: 574649 - DNA, 501 bp, Homo sapiens; identical to SEQ ID NO: 555551
  misc_feature: HIJSMM301EM4FS.21.81.H04.1.454.light.4.raw

SEQ ID NO: 574650 - DNA, 486 bp, Homo sapiens; identical to SEQ ID NO: 546042
  misc_feature: HIJSMM301EEGVS.14.53.E09.1.454.light.4.raw

SEQ ID NO: 574651 - DNA, 496 bp, Homo sapiens; identical to SEQ ID NO: 540207
  misc_feature: HIJSMM301BCFDB.40.57.F02.1.454.light.4.raw

SEQ ID NO: 574652 - DNA, 508 bp, Homo sapiens; identical to SEQ ID NO: 540640
  misc_feature: HIJSMM301AM7MA.5.60.F05.1.454.light.4.raw

SEQ ID NO: 574653 - DNA, 485 bp, Homo sapiens; identical to SEQ ID NO: 540394
  misc_feature: HIJSMM301DE930.46.26.C04.1.454.light.4.raw

SEQ ID NO: 574654 - DNA, 486 bp, Homo sapiens
  misc_feature: HIJSMM301DQWCN.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgttgggtgttcggcggagggaccaagctgaccgtcctaggtcacg

SEQ ID NO: 574655 - DNA, 447 bp, Homo sapiens
  misc_feature: HIJSMM301C7CHC.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgatgatgaggctgattattactgccagtcctatgacactaatctcagtggtctgggggtcttcggcggagggaccaggctgaccgtcgtgggtcagcccaaggctgccccctcggtcactctgttcccaccctcctccatactcgta

SEQ ID NO: 574656 - DNA, 515 bp, Homo sapiens; identical to SEQ ID NO: 570572
  misc_feature: HIJSMM301C8WLO.14.66.F11.1.454.light.4.raw

SEQ ID NO: 574657 - DNA, 502 bp, Homo sapiens
  misc_feature: HIJSMM301AEGU0.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgatttttactgcggaacatgggataccagcctgcatggtgtggttttcggcggaggaccaagctgaccgtcctaagtcagcccaaggctgccccc

SEQ ID NO: 574658 - DNA, 497 bp, Homo sapiens; identical to SEQ ID NO: 535286
  misc_feature: HIJSMM301EARPO.18.59.F04.1.454.light.4.raw

SEQ ID NO: 574659 - DNA, 523 bp, Homo sapiens
  misc_feature: HIJSMM301EZRZ3.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgtaggacgagtctacttattactgcagttcctttaaattaaggcgccactctcgtggttttcggtcggaggcaccgaagtgaccgtcctcggtcgagcccaaggctcgccccctccggtcactcttcg

SEQ ID NO: 574660 - DNA, 520 bp, Homo sapiens; identical to SEQ ID NO: 554405
  misc_feature: HIJSMM301BH4CL.5.27.C05.1.454.light.4.raw

SEQ ID NO: 574661 - DNA, 513 bp, Homo sapiens; identical to SEQ ID NO: 547420
  misc_feature: HIJSMM301A2N1K.11.57.F02.1.454.light.4.raw

SEQ ID NO: 574662 - DNA, 490 bp, Homo sapiens; identical to SEQ ID NO: 541974
  misc_feature: HIJSMM301DFEAT.22.65.F10.1.454.light.4.raw

SEQ ID NO: 574663 - DNA, 463 bp, Homo sapiens; identical to SEQ ID NO: 535062
  misc_feature: HIJSMM301AIS35.11.73.G07.1.454.light.4.raw

SEQ ID NO: 574664 - DNA, 490 bp, Homo sapiens; identical to SEQ ID NO: 541974
  misc_feature: HIJSMM301CNV5Q.22.65.F10.1.454.light.4.raw

SEQ ID NO: 574665 - DNA, 516 bp, Homo sapiens
  misc_feature: HIJSMM301CURNW.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggccaacccactgtcactctcg

SEQ ID NO: 574666 - DNA, 445 bp, Homo sapiens
  misc_feature: HIJSMM301BQ5DN.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcgggctgaggatgaggctgattattactgccactcctatgacagcagcctgagaagtgtggtattcggcggagggaccaagctgaccgtcctaggtcagcccaaggctgccccctcggtcactctcgttcccaccctcctcagacgtatca

SEQ ID NO: 574667 - DNA, 479 bp, Homo sapiens; identical to SEQ ID NO: 537163
  misc_feature: HIJSMM301BNT06.13.73.G07.1.454.light.4.raw

SEQ ID NO: 574668 - DNA, 516 bp, Homo sapiens; identical to SEQ ID NO: 547638
  misc_feature: HIJSMM301AUOQM.47.53.E09.1.454.light.4.raw

SEQ ID NO: 574669 - DNA, 476 bp, Homo sapiens; identical to SEQ ID NO: 538611
  misc_feature: HIJSMM301DM01A.7.81.H04.1.454.light.4.raw

SEQ ID NO: 574670 - DNA, 508 bp, Homo sapiens
  misc_feature: HIJSMM301ALE4G.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttccgccat

SEQ ID NO: 574671 - DNA, 484 bp, Homo sapiens
  misc_feature: HIJSMM301AIXPY.4.27.C05.1.454.light.4.raw
agcactgtagcacgaccggtgctcgatttagacgcgatcgaagggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaact

SEQ ID NO: 574672 - DNA, 458 bp, Homo sapiens
  misc_feature: HIJSMM301ER64B.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctctatgtcttcggaactgggaccaaggtcaccgtcctaggtcagcccaaggccaaccccactgtcactctgttccccgccctcctccatactcgta

SEQ ID NO: 574673 - DNA, 484 bp, Homo sapiens
  misc_feature: HIJSMM301A36K7.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaatgaccgtcctaggtcagcccaaggctgccccccg

SEQ ID NO: 574674 - DNA, 509 bp, Homo sapiens; identical to SEQ ID NO: 553073
  misc_feature: HIJSMM301AN087.16.1.A01.1.454.light.4.raw

SEQ ID NO: 574675 - DNA, 487 bp, Homo sapiens; identical to SEQ ID NO: 541583
  misc_feature: HIJSMM301CJYFD.41.57.F02.1.454.light.4.raw

SEQ ID NO: 574676 - DNA, 490 bp, Homo sapiens
  misc_feature: HIJSMM301BO9UN.4.75.G09.1.454.light.4.raw
agcactgtagcacgaccggtgctcgatttagtatagacatcagggggagctacaacaggcaggcaggggcagcaagatggtgttgcagacccaggtcttcatttctctgttgctctggatctctggtgcctacggggacatcgtgctgacccagtctccagactccctggctgtgtctctgggcgagagggccaccatcaactgcaagtccagccagagtgttttatacagctccaataataagaattatttaggttggtaccagcagaaaccagggcagcctcctaaactgctcatttactgggcatctacccgggaatccggggtccctgaccgattcactggcagcgggtctgggacagatttcactctcacgatcagcagcctgcaggctgaagatgtggcagtttattactgtcaacagtattataatagtccgatcaccttcggccaagggacacgactggagattaacgaactgtggctgcac

SEQ ID NO: 574677 - DNA, 513 bp, Homo sapiens
  misc_feature: HIJSMM301BGIYD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaacgggaccgaaggtaggaaagtcaaaacgaactagtaggctgcaccaatctgtcttcatcttccccg

SEQ ID NO: 574678 - DNA, 447 bp, Homo sapiens; identical to SEQ ID NO: 535201
  misc_feature: HIJSMM301DZYMH.18.9.A09.1.454.light.4.raw

SEQ ID NO: 574679 - DNA, 516 bp, Homo sapiens
  misc_feature: HIJSMM301D4NRB.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccttcctccgtgt

SEQ ID NO: 574680 - DNA, 520 bp, Homo sapiens
  misc_feature: HIJSMM301AIYQW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttctcgggcgttcggtccgaacgggaaccgaaggtaggaaagtaacaaacgaactagtggctcgcaccatctcgtcttctacttccttccccg

SEQ ID NO: 574681 - DNA, 504 bp, Homo sapiens; identical to SEQ ID NO: 535935
  misc_feature: HIJSMM301A4OI6.18.78.H01.1.454.light.4.raw

SEQ ID NO: 574682 - DNA, 484 bp, Homo sapiens; identical to SEQ ID NO: 536162
  misc_feature: HIJSMM301BHP15.13.59.F04.1.454.light.4.raw

SEQ ID NO: 574683 - DNA, 492 bp, Homo sapiens; identical to SEQ ID NO: 537666
  misc_feature: HIJSMM301DRZXO.43.33.C11.1.454.light.4.raw

SEQ ID NO: 574684 - DNA, 494 bp, Homo sapiens; identical to SEQ ID NO: 541400
  misc_feature: HIJSMM301AIQWI.51.71.G05.1.454.light.4.raw

SEQ ID NO: 574685 - DNA, 476 bp, Homo sapiens; identical to SEQ ID NO: 561229
  misc_feature: HIJSMM301EY04W.52.73.G07.1.454.light.4.raw

SEQ ID NO: 574686 - DNA, 513 bp, Homo sapiens
  misc_feature: HIJSMM301D5GB4.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctcgccccctcggtcact

SEQ ID NO: 574687 - DNA, 479 bp, Homo sapiens; identical to SEQ ID NO: 535586
  misc_feature: HIJSMM301EV77K.13.34.D01.1.454.light.4.raw

SEQ ID NO: 574688 - DNA, 499 bp, Homo sapiens; identical to SEQ ID NO: 562784
  misc_feature: HIJSMM301D86DY.40.23.C01.1.454.light.4.raw

SEQ ID NO: 574689 - DNA, 485 bp, Homo sapiens; identical to SEQ ID NO: 538533
  misc_feature: HIJSMM301EOBO3.47.78.H01.1.454.light.4.raw

SEQ ID NO: 574690 - DNA, 495 bp, Homo sapiens; identical to SEQ ID NO: 543631
  misc_feature: HIJSMM301B7I4W.11.59.F04.1.454.light.4.raw

SEQ ID NO: 574691 - DNA, 480 bp, Homo sapiens; identical to SEQ ID NO: 535291
  misc_feature: HIJSMM301D99JD.22.59.F04.1.454.light.4.raw

SEQ ID NO: 574692 - DNA, 310 bp, Homo sapiens
  misc_feature: HIJSMM301B45NK.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggat

SEQ ID NO: 574693 - DNA, 500 bp, Homo sapiens; identical to SEQ ID NO: 540012
  misc_feature: HIJSMM301CU3YR.52.34.D01.1.454.light.4.raw

SEQ ID NO: 574694 - DNA, 511 bp, Homo sapiens
  misc_feature: HIJSMM301BBNHL.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctggtcagcccaaggctgccccctcggtcactctgttccccg

SEQ ID NO: 574695 - DNA, 504 bp, Homo sapiens
  misc_feature: HIJSMM301BSRJT.48.28.C06.1.454.light.4.raw
agtatacatacacgaccggtgctcgatttagagctcacgtattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 574696 - DNA, 505 bp, Homo sapiens; identical to SEQ ID NO: 535503
  misc_feature: HIJSMM301AOZQC.8.28.C06.1.454.light.4.raw

SEQ ID NO: 574697 - DNA, 500 bp, Homo sapiens; identical to SEQ ID NO: 543202
  misc_feature: HIJSMM301EHM25.5.86.H09.1.454.light.4.raw

SEQ ID NO: 574698 - DNA, 442 bp, Homo sapiens; identical to SEQ ID NO: 563958
  misc_feature: HIJSMM301DRBHH.11.3.A03.1.454.light.4.raw

SEQ ID NO: 574699 - DNA, 481 bp, Homo sapiens
  misc_feature: HIJSMM301CAQQ1.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagatttgcggtttattactgtcagcagtatgataactggctgtacacttttggccaggggaccaagctggagatcaggcgaactgtggctgca

SEQ ID NO: 574700 - DNA, 478 bp, Homo sapiens; identical to SEQ ID NO: 535129
  misc_feature: HIJSMM301DTNTU.11.11.A11.1.454.light.4.raw

SEQ ID NO: 574701 - DNA, 496 bp, Homo sapiens
  misc_feature: HIJSMM301BHPJZ.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactc

SEQ ID NO: 574702 - DNA, 502 bp, Homo sapiens; identical to SEQ ID NO: 543913
  misc_feature: HIJSMM301C3ZHY.18.26.C04.1.454.light.4.raw

SEQ ID NO: 574703 - DNA, 511 bp, Homo sapiens
  misc_feature: HIJSMM301D8AMX.17.37.D04.1.454.light.4.raw
cgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtcctggtcagcccaaggctgccccctggtcactctgttcccg

SEQ ID NO: 574704 - DNA, 486 bp, Homo sapiens; identical to SEQ ID NO: 536323
  misc_feature: HIJSMM301DYQRO.10.2.A02.1.454.light.4.raw

SEQ ID NO: 574705 - DNA, 478 bp, Homo sapiens
  misc_feature: HIJSMM301AY5TP.48.38.D05.1.454.light.4.raw
agtatacatacacgaccggtgctcgatttagtatctgatagttgggtttgggggcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtata

SEQ ID NO: 574706 - DNA, 521 bp, Homo sapiens; identical to SEQ ID NO: 539470
  misc_feature: HIJSMM301AJB4I.27.23.C01.1.454.light.4.raw

SEQ ID NO: 574707 - DNA, 460 bp, Homo sapiens; identical to SEQ ID NO: 536053
  misc_feature: HIJSMM301BSOT7.22.28.C06.1.454.light.4.raw

SEQ ID NO: 574708 - DNA, 494 bp, Homo sapiens; identical to SEQ ID NO: 535276
  misc_feature: HIJSMM301C4MEP.16.6.A06.1.454.light.4.raw

SEQ ID NO: 574709 - DNA, 496 bp, Homo sapiens; identical to SEQ ID NO: 538625
  misc_feature: HIJSMM301BNC9T.2.49.E05.1.454.light.4.raw

SEQ ID NO: 574710 - DNA, 505 bp, Homo sapiens; identical to SEQ ID NO: 543540
  misc_feature: HIJSMM301A4CNG.9.12.B01.1.454.light.4.raw

SEQ ID NO: 574711 - DNA, 485 bp, Homo sapiens; identical to SEQ ID NO: 535606
  misc_feature: HIJSMM301B6K8U.47.46.E02.1.454.light.4.raw

SEQ ID NO: 574712 - DNA, 444 bp, Homo sapiens; identical to SEQ ID NO: 535192
  misc_feature: HIJSMM301D80NF.5.9.A09.1.454.light.4.raw

SEQ ID NO: 574713 - DNA, 497 bp, Homo sapiens; identical to SEQ ID NO: 535286
  misc_feature: HIJSMM301EJNX9.18.59.F04.1.454.light.4.raw

SEQ ID NO: 574714 - DNA, 504 bp, Homo sapiens
  misc_feature: HIJSMM301DF2JB.5.24.C02.1.454.light.4.raw
atcagacacgcacgaccggtgctcgatttagtacagatcgttagggaaaggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgcccccg

SEQ ID NO: 574715 - DNA, 496 bp, Homo sapiens
  misc_feature: HIJSMM301DI5WN.48.60.F05.1.454.light.4.raw
agtatacatacacgaccggtgctcgatttagtacgtcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctccactttcggcggagggaccagggtggacgtcaaacgaactgtggctgcaccatctgtcttcatcttcccgccta

SEQ ID NO: 574716 - DNA, 507 bp, Homo sapiens
  misc_feature: HIJSMM301BHMOJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcgtccaaggaccgaaggtggaaagtcaaacgaaactgtaggctgcaccatctgtcttctatcttccccg

SEQ ID NO: 574717 - DNA, 483 bp, Homo sapiens
  misc_feature: HIJSMM301C5ST9.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgctaacttattactgtcaacagagtaactacgttaccctccctactttcggcggagggaccgaaggtggagatacaaacgaactgtggctgcaccatctgtt

SEQ ID NO: 574718 - DNA, 504 bp, Homo sapiens
  misc_feature: HIJSMM301EZ2QO.19.78.H01.1.454.light.4.raw
  modified_base (498)..(498): a, c, t, g, unknown or other
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaaccccnctgtca

SEQ ID NO: 574719 - DNA, 499 bp, Homo sapiens
  misc_feature: HIJSMM301CQCL3.43.79.H02.1.454.light.4.raw
  modified_base (425)..(425): a, c, t, g, unknown or other
tgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctgggacccccgggcagagggtcaccatctcttgttctggaagcagctccaacatcggaagtaattatgtatattggtaccagcagctcccaagaacggccccaaattcctcatctataggaataatcagcggccctcaggggtccctgaccgattctctggctccaagtctggcacctcacgccctcctggccatcgagtcggcgtccggtcgaggatgaggctgattattactgtncagcatggatggacagcctagtgtggtgtgggtattcggcggaggaccaaggctggacccgtcgtacggtcgag

SEQ ID NO: 574720 - DNA, 497 bp, Homo sapiens
  misc_feature: HIJSMM301DYKMI.41.14.B03.1.454.light.4.raw
tctatactatcacgaccggtgctcgatttagtgtgagtagttccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcgagggaccaagctgaccgtcctaggtcagcccaaggctcg

SEQ ID NO: 574721 - DNA, 497 bp, Homo sapiens
  misc_feature: HIJSMM301C32ZO.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatcccaccagggccactggtatcccagaccggttcagtggcagtgggtctgggacagacttcactctcaccatcagcagtctgcagtctgaagattttgctagtttattactgtcagcagtataataactggcctccgtacatgtacacttttggcctaggggaccaaccgtggagatcagacgaa

SEQ ID NO: 574722 - DNA, 494 bp, Homo sapiens; identical to SEQ ID NO: 542031
  misc_feature: HIJSMM301AYHG0.12.23.C01.1.454.light.4.raw

SEQ ID NO: 574723 - DNA, 490 bp, Homo sapiens
  misc_feature: HIJSMM301D8F63.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgtagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgcaccatctgtt

SEQ ID NO: 574724 - DNA, 488 bp, Homo sapiens
  misc_feature: HIJSMM301EB8SN.17.34.D01.1.454.light.4.raw
  modified_base (421)..(421): a, c, t, g, unknown or other
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcggggtcagggacagattttacactgaaaatcagccgggtggaggctgaggacgttggaattttnttactgtatgcaaggtatagagcttcctccgacgttcggccagggaccaaggtggaactcaaacgaa

SEQ ID NO: 574725 - DNA, 518 bp, Homo sapiens
  misc_feature: HIJSMM301BCUV2.3.37.D04.1.454.light.4.raw
agacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcactc

SEQ ID NO: 574726 - DNA, 447 bp, Homo sapiens; identical to SEQ ID NO: 535201
  misc_feature: HIJSMM301A9TMA.18.9.A09.1.454.light.4.raw

SEQ ID NO: 574727 - DNA, 501 bp, Homo sapiens
  misc_feature: HIJSMM301AES87.48.68.G02.1.454.light.4.raw
agtatacatacacgaccggtgctcgatttagtcgatagtgaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactagtggctgcaccatctgtcttcatcttcccgt

SEQ ID NO: 574728 - DNA, 504 bp, Homo sapiens; identical to SEQ ID NO: 538977
  misc_feature: HIJSMM301EMABM.48.37.D04.1.454.light.4.raw

SEQ ID NO: 574729 - DNA, 478 bp, Homo sapiens; identical to SEQ ID NO: 545407
  misc_feature: HIJSMM301D8Y4S.5.70.G04.1.454.light.4.raw

SEQ ID NO: 574730 - DNA, 486 bp, Homo sapiens; identical to SEQ ID NO: 536329
  misc_feature: HIJSMM301C1BE4.21.4.A04.1.454.light.4.raw

SEQ ID NO: 574731 - DNA, 499 bp, Homo sapiens; identical to SEQ ID NO: 545133
  misc_feature: HIJSMM301CCL84.48.83.H06.1.454.light.4.raw

SEQ ID NO: 574732 - DNA, 481 bp, Homo sapiens; identical to SEQ ID NO: 535993
  misc_feature: HIJSMM301CU1RZ.21.25.C03.1.454.light.4.raw

SEQ ID NO: 574733 - DNA, 494 bp, Homo sapiens
  misc_feature: HIJSMM301CE0CR.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctacaccta

SEQ ID NO: 574734 - DNA, 485 bp, Homo sapiens; identical to SEQ ID NO: 535688
  misc_feature: HIJSMM301DBI5M.19.5.A05.1.454.light.4.raw

SEQ ID NO: 574735 - DNA, 502 bp, Homo sapiens
  misc_feature: HIJSMM301D1GG3.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggctttcggcggagggaccaagctgaccgtcctgggtcagcccaaggctgcccctcggtca

SEQ ID NO: 574736 - DNA, 478 bp, Homo sapiens; identical to SEQ ID NO: 540986
  misc_feature: HIJSMM301B8GKW.16.86.H09.1.454.light.4.raw

SEQ ID NO: 574737 - DNA, 487 bp, Homo sapiens
  misc_feature: HIJSMM301EBIHL.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttaaactgaaaatcagcagagtggaggctgaggatgttgggctctattattgcatgcaagctctacaagtcccgctcactttcggcgagggaccaaggtggagatcaaacgaactgt

SEQ ID NO: 574738 - DNA, 504 bp, Homo sapiens
  misc_feature: HIJSMM301APPHW.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaacctacatcatttatgatgccactaagcggccctccaggggtttcgtaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccgccctcctccaccgagagta

SEQ ID NO: 574739 - DNA, 508 bp, Homo sapiens
  misc_feature: HIJSMM301CIVZM.16.38.D05.1.454.light.4.raw
tgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatcctaccagggccactgatgtcccaggccggttcagtggcaggtgggtttgggacagacttcactctcaccatcagcaccctgcagtctggaggtattttgctaaattttattattgtcagcagtattaattactggcctccgtactacttttggccaggggaccaagctggagatcaaacgactgtggctgcaccatctgtcttcatt

SEQ ID NO: 574740 - DNA, 486 bp, Homo sapiens; identical to SEQ ID NO: 553608
  misc_feature: HIJSMM301BWVV1.11.12.B01.1.454.light.4.raw

SEQ ID NO: 574741 - DNA, 495 bp, Homo sapiens
  misc_feature: HIJSMM301AOTPY.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccgaagggacacgactggagattaaacgaactgtggctgcaccatctgtctt

SEQ ID NO: 574742 - DNA, 514 bp, Homo sapiens
  misc_feature: HIJSMM301CLUQY.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccctacctcct

SEQ ID NO: 574743 - DNA, 492 bp, Homo sapiens
  misc_feature: HIJSMM301EX3CK.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggccgcaccatctgtcttcattcc

SEQ ID NO: 574744 - DNA, 494 bp, Homo sapiens; identical to SEQ ID NO: 539894
  misc_feature: HIJSMM301BVM7G.16.53.E09.1.454.light.4.raw

SEQ ID NO: 574745 - DNA, 513 bp, Homo sapiens; identical to SEQ ID NO: 559106
  misc_feature: HIJSMM301CTV2A.11.57.F02.1.454.light.4.raw

SEQ ID NO: 574746 - DNA, 496 bp, Homo sapiens; identical to SEQ ID NO: 535541
  misc_feature: HIJSMM301DX5L9.3.33.C11.1.454.light.4.raw

SEQ ID NO: 574747 - DNA, 477 bp, Homo sapiens; identical to SEQ ID NO: 537453
  misc_feature: HIJSMM301C7ZNV.8.85.H08.1.454.light.4.raw

SEQ ID NO: 574748 - DNA, 494 bp, Homo sapiens
  misc_feature: HIJSMM301DZFBU.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcacgtctcaccatcagcagcctgcagtctgaagattttgcagtttattactgtcagcagtatgatacctggcctccgtacacttttggccggggaccaagctggaaatcaaagcgaactgtggctgcaccatctgtcttcatt

SEQ ID NO: 574749 - DNA, 494 bp, Homo sapiens; identical to SEQ ID NO: 534994
  misc_feature: HIJSMM301ARWRQ.27.78.H01.1.454.light.4.raw

SEQ ID NO: 574750 - DNA, 487 bp, Homo sapiens; identical to SEQ ID NO: 537220
  misc_feature: HIJSMM301CK9WE.16.53.E09.1.454.light.4.raw

SEQ ID NO: 574751 - DNA, 466 bp, Homo sapiens; identical to SEQ ID NO: 535366
  misc_feature: HIJSMM301DKJ78.13.4.A04.1.454.light.4.raw

SEQ ID NO: 574752 - DNA, 485 bp, Homo sapiens
  misc_feature: HIJSMM301EBW2O.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtcctggtcagcccaaggctgccccc

SEQ ID NO: 574753 - DNA, 502 bp, Homo sapiens
  misc_feature: HIJSMM301AGK2S.14.55.E11.1.454.light.4.raw
  modified_base (425)..(425): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccnctactcgtcggacggacggaacgaggcgagacacgacgaactacgtggtcgtcgtcgaccactactcgtcgttctta

SEQ ID NO: 574754 - DNA, 510 bp, Homo sapiens
  misc_feature: HIJSMM301EYLLT.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtggttcggcggagggaccaggctgaccgtcctaagtcagcccaaggctgccccctc

SEQ ID NO: 574755 - DNA, 494 bp, Homo sapiens; identical to SEQ ID NO: 535276
  misc_feature: HIJSMM301C3434.16.6.A06.1.454.light.4.raw

SEQ ID NO: 574756 - DNA, 496 bp, Homo sapiens; identical to SEQ ID NO: 537925
  misc_feature: HIJSMM301B0Y66.22.14.B03.1.454.light.4.raw

SEQ ID NO: 574757 - DNA, 495 bp, Homo sapiens; identical to SEQ ID NO: 536055
  misc_feature: HIJSMM301DZUXT.47.38.D05.1.454.light.4.raw

SEQ ID NO: 574758 - DNA, 504 bp, Homo sapiens; identical to SEQ ID NO: 535495
  misc_feature: HIJSMM301DBNQ1.14.86.H09.1.454.light.4.raw

SEQ ID NO: 574759 - DNA, 489 bp, Homo sapiens; identical to SEQ ID NO: 535091
  misc_feature: HIJSMM301CVJA6.47.36.D03.1.454.light.4.raw

SEQ ID NO: 574760 - DNA, 479 bp, Homo sapiens; identical to SEQ ID NO: 540569
  misc_feature: HIJSMM301DRT36.5.70.G04.1.454.light.4.raw

SEQ ID NO: 574761 - DNA, 510 bp, Homo sapiens
  misc_feature: HIJSMM301DRKOK.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccaaagtggatatcaaacgaactagtggctgcaccatctgtcttcta

SEQ ID NO: 574762 - DNA, 485 bp, Homo sapiens; identical to SEQ ID NO: 539315
  misc_feature: HIJSMM301C6RLT.3.88.H11.1.454.light.4.raw

SEQ ID NO: 574763 - DNA, 502 bp, Homo sapiens
  misc_feature: HIJSMM301CBIEQ.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtactttcggcggagggaccaagctgaccgtctgggtcagcccaaggctgccccctcggtcta

SEQ ID NO: 574764 - DNA, 504 bp, Homo sapiens
  misc_feature: HIJSMM301ENZSL.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctggggacagacttcactctcaccatcagcagcctagagcctgaagattttgcagtttattactgtcagcagcgtgccactttcggcggaggtgccactttcggcggagggaccaaaatagaggtcaaacgaactagtggctgcaccatctgtcttcatt

SEQ ID NO: 574765 - DNA, 491 bp, Homo sapiens
  misc_feature: HIJSMM301DM0ND.48.63.F08.1.454.light.4.raw
agtatacatacacgaccggtgctcgatttagcgatcgtataagggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaagcccctaactcctaatctatgaggcatctactctacaaagtggagtcccatccaggttcagcggcagtgcatctgggaccgacttcagtctcaccatcagcagcctgcaccctgatgattttgcaacttattactgtcaacaatattatacttaccgtacacttttggccagggactaagctggagatcaaacgaactgtggctgcaccatctgtcttcatcttccccg

SEQ ID NO: 574766 - DNA, 486 bp, Homo sapiens; identical to SEQ ID NO: 553608
  misc_feature: HIJSMM301C11ZW.11.12.B01.1.454.light.4.raw

SEQ ID NO: 574767 - DNA, 486 bp, Homo sapiens
  misc_feature: HIJSMM301DA8U6.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccatttgcaaagtggggtcccaccaaatttcagtggcagtggatctgggacagatttcactctcagcattaataatctgcaacctgaggattttgctaacttactactgtcaacagagttacacggccccctatacttttggccaggggaccaagctggagatcacaggaactgtggctgcacc

SEQ ID NO: 574768 - DNA, 488 bp, Homo sapiens
  misc_feature: HIJSMM301AZUA4.52.42.D09.1.454.light.4.raw
cgcagtacgacacgaccggtgctcgatttagacacatacgcagggaaaggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtc

SEQ ID NO: 574769 - DNA, 521 bp, Homo sapiens
  misc_feature: HIJSMM301E0NMU.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataacttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggagggaccaggctgaccgtcctaggtcagcccaaggctgccccctcggtcactctgttcccacct

SEQ ID NO: 574770 - DNA, 500 bp, Homo sapiens
  misc_feature: HIJSMM301BN1G0.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagccttgagcctgaagattttgcagtttattactgtcagcagcgtagcaactggcctccgatcaccttcggccaagggacacgactggagattaaacgaactgtggctgcaccatctgtcttcatt

SEQ ID NO: 574771 - DNA, 494 bp, Homo sapiens; identical to SEQ ID NO: 539894
  misc_feature: HIJSMM301AUBFN.16.53.E09.1.454.light.4.raw

SEQ ID NO: 574772 - DNA, 514 bp, Homo sapiens; identical to SEQ ID NO: 547648
  misc_feature: HIJSMM301D4DUL.16.1.A01.1.454.light.4.raw

SEQ ID NO: 574773 - DNA, 504 bp, Homo sapiens; identical to SEQ ID NO: 538940
  misc_feature: HIJSMM301D118Y.2.35.D02.1.454.light.4.raw

SEQ ID NO: 574774 - DNA, 486 bp, Homo sapiens; identical to SEQ ID NO: 535043
  misc_feature: HIJSMM301BLE87.46.35.D02.1.454.light.4.raw

SEQ ID NO: 574775 - DNA, 497 bp, Homo sapiens; identical to SEQ ID NO: 535664
  misc_feature: HIJSMM301DRRHJ.22.14.B03.1.454.light.4.raw

SEQ ID NO: 574776 - DNA, 509 bp, Homo sapiens; identical to SEQ ID NO: 535457
  misc_feature: HIJSMM301BB2RZ.17.33.C11.1.454.light.4.raw

SEQ ID NO: 574777 - DNA, 514 bp, Homo sapiens
  misc_feature: HIJSMM301DV35C.48.53.E09.1.454.light.4.raw
agtatacatacacgaccggtgctcgatttagagagagtgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcaggcccaaggctgccccctcggtccactctgttcccaccct

SEQ ID NO: 574778 - DNA, 503 bp, Homo sapiens; identical to SEQ ID NO: 559656
  misc_feature: HIJSMM301DPVLQ.48.57.F02.1.454.light.4.raw

SEQ ID NO: 574779 - DNA, 486 bp, Homo sapiens; identical to SEQ ID NO: 535043
  misc_feature: HIJSMM301DEQ79.46.35.D02.1.454.light.4.raw

SEQ ID NO: 574780 - DNA, 495 bp, Homo sapiens
  misc_feature: HIJSMM301A38E0.21.27.C05.1.454.light.4.raw
  modified_base (361)..(361): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttcnctcaccatcagcgccctacagagtgaagatgttgcagtttatttctgccagcaatataattactggcctgcgtcgacgttcggccacgggaccaaggtggaaatcaaacgaactgtggctgcaccatctgtctt

SEQ ID NO: 574781 - DNA, 510 bp, Homo sapiens
  misc_feature: HIJSMM301B13WF.48.56.F01.1.454.light.4.raw
agtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacactcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctgccccctcggtcact

SEQ ID NO: 574782 - DNA, 472 bp, Homo sapiens; identical to SEQ ID NO: 556898
  misc_feature: HIJSMM301AP19A.13.76.G10.1.454.light.4.raw

SEQ ID NO: 574783 - DNA, 496 bp, Homo sapiens; identical to SEQ ID NO: 552644
  misc_feature: HIJSMM301AIYO9.26.80.H03.1.454.light.4.raw

SEQ ID NO: 574784 - DNA, 499 bp, Homo sapiens; identical to SEQ ID NO: 547269
  misc_feature: HIJSMM301AROQE.14.59.F04.1.454.light.4.raw

SEQ ID NO: 574785 - DNA, 485 bp, Homo sapiens; identical to SEQ ID NO: 536576
  misc_feature: HIJSMM301A16C4.46.35.D02.1.454.light.4.raw

SEQ ID NO: 574786 - DNA, 475 bp, Homo sapiens
  misc_feature: HIJSMM301BOBZ1.51.87.H10.1.454.light.4.raw
cgatcgtatacacgaccggtgctcgatttagcagtactgcgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtggctgca

SEQ ID NO: 574787 - DNA, 485 bp, Homo sapiens
  misc_feature: HIJSMM301APFUW.46.35.D02.1.454.light.4.raw
  modified_base (480)..(480): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcagtcccaagaacttttggccaggggaccaagctggagatcaaacgaactgtggctgnaccat

SEQ ID NO: 574788 - DNA, 488 bp, Homo sapiens
  misc_feature: HIJSMM301BTU0P.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctccagtgcgtgggttttcggcggagggaccgaagactgaccgtcctaggtcagaccccg

SEQ ID NO: 574789 - DNA, 503 bp, Homo sapiens
  misc_feature: HIJSMM301ES94U.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattatactgctactcatatgcaggcggcaactcttgggtgttcggcggagggaccaagctgaccgtcctaggtcagcccaaggctgccccctggtcactctcg

SEQ ID NO: 574790 - DNA, 510 bp, Homo sapiens
  misc_feature: HIJSMM301DJV7U.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctcccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgtt

SEQ ID NO: 574791 - DNA, 447 bp, Homo sapiens; identical to SEQ ID NO: 535201
  misc_feature: HIJSMM301ELGPH.18.9.A09.1.454.light.4.raw

SEQ ID NO: 574792 - DNA, 494 bp, Homo sapiens; identical to SEQ ID NO: 535276
  misc_feature: HIJSMM301BWS6I.16.6.A06.1.454.light.4.raw

SEQ ID NO: 574793 - DNA, 441 bp, Homo sapiens; identical to SEQ ID NO: 534971
  misc_feature: HIJSMM301DZHU4.11.3.A03.1.454.light.4.raw

SEQ ID NO: 574794 - DNA, 492 bp, Homo sapiens; identical to SEQ ID NO: 538644
  misc_feature: HIJSMM301D4GK8.26.78.H01.1.454.light.4.raw

SEQ ID NO: 574795 - DNA, 508 bp, Homo sapiens
  misc_feature: HIJSMM301AI9Q8.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaaagctgccctcaccatcgcgggggcccaggcagatgatgagtgtgattattactgtgtgctctatatgggcagtggcgtttgggtgttcggcggagggaccgaagctgaccgtcg

SEQ ID NO: 574796 - DNA, 485 bp, Homo sapiens
  misc_feature: HIJSMM301AGS3M.51.36.D03.1.454.light.4.raw
cgatcgtatacacgaccggtgctcgatttagctgcgtcacgatctctcttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctgggagcagctccaacatcggaactaatactgtgaactggtaccagcaactcccaggaacggcccccaaactcctcatctacagtaatagtcagcggccctcaggggtccctgaccgattctctggctccaagtctggctcctcagcctcctggccatcagtggctccagtctgaggatgaggctgattattactgtgcagcgtgggatggcagcctgaatggttatgtcttcggaatgggaccaaggtcacgtcct

SEQ ID NO: 574797 - DNA, 501 bp, Homo sapiens; identical to SEQ ID NO: 540528
  misc_feature: HIJSMM301C3YO2.11.31.C09.1.454.light.4.raw

SEQ ID NO: 574798 - DNA, 498 bp, Homo sapiens
  misc_feature: HIJSMM301DDLEP.10.68.G02.1.454.light.4.raw
catagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccaggggtcgatgaggctgactactactgtttctcgactgacttcactggtaaacgttggctgttcggcggagggaccaagctgaccgtcctgcgtcagcccaaggctgccccctcggtcact

SEQ ID NO: 574799 - DNA, 503 bp, Homo sapiens; identical to SEQ ID NO: 540029
  misc_feature: HIJSMM301BIR1F.7.71.G05.1.454.light.4.raw

SEQ ID NO: 574800 - DNA, 486 bp, Homo sapiens
  misc_feature: HIJSMM301B0FT6.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggccaagggtcaccgtcctaggtcagcccaaggccaaa

SEQ ID NO: 574801 - DNA, 494 bp, Homo sapiens; identical to SEQ ID NO: 534992
  misc_feature: HIJSMM301EB07O.9.1.A01.1.454.light.4.raw

SEQ ID NO: 574802 - DNA, 481 bp, Homo sapiens; identical to SEQ ID NO: 535314
  misc_feature: HIJSMM301AES0O.10.4.A04.1.454.light.4.raw

SEQ ID NO: 574803 - DNA, 495 bp, Homo sapiens; identical to SEQ ID NO: 545183
  misc_feature: HIJSMM301CZGJX.16.10.A10.1.454.light.4.raw

SEQ ID NO: 574804 - DNA, 445 bp, Homo sapiens
  misc_feature: HIJSMM301D9B4J.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttccccgccctcctcgtactagacg

SEQ ID NO: 574805 - DNA, 509 bp, Homo sapiens; identical to SEQ ID NO: 539359
  misc_feature: HIJSMM301CQS3K.47.85.H08.1.454.light.4.raw

SEQ ID NO: 574806 - DNA, 494 bp, Homo sapiens; identical to SEQ ID NO: 534992
  misc_feature: HIJSMM301BYL8A.9.1.A01.1.454.light.4.raw

SEQ ID NO: 574807 - DNA, 481 bp, Homo sapiens; identical to SEQ ID NO: 535061
  misc_feature: HIJSMM301C1LAV.16.81.H04.1.454.light.4.raw

SEQ ID NO: 574808 - DNA, 471 bp, Homo sapiens
  misc_feature: HIJSMM301ELPNT.51.78.H01.1.454.light.4.raw
cgatcgtatacacgaccggtgctcgatttagtgtgagtagtttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaa

SEQ ID NO: 574809 - DNA, 500 bp, Homo sapiens
  misc_feature: HIJSMM301D7ALL.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctcgttcccgccctcctctgtcgagcgt

SEQ ID NO: 574810 - DNA, 479 bp, Homo sapiens
  misc_feature: HIJSMM301BD1TK.48.87.H10.1.454.light.4.raw
agtatacatacacgaccggtgctcgatttagcagtactgcgttgggtttgggggggccgtcaggaagcagcatcggagggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggaggggacccaagctgaccgtcctaagtcagccc

SEQ ID NO: 574811 - DNA, 509 bp, Homo sapiens
  misc_feature: HIJSMM301AYOFU.48.36.D03.1.454.light.4.raw
agtatacatacacgaccggtgctcgatttagctgcgtcacgatctctcttggggggggtcgtcaggaggcagcactctcgggacggtctccaccatggcctgggctctgctcctcctcagcctcctcactcagggcgacaggatcctgggctcagtctgccctgactcggcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttccttttttgtcttcggaactgggaccgaggtcaccgtcctaggtcagcccaaggccaaccccactgtcact

SEQ ID NO: 574812 - DNA, 503 bp, Homo sapiens
  misc_feature: HIJSMM301AZUVG.48.74.G08.1.454.light.4.raw
agtatacatacacgaccggtgctcgatttagtagctctatcaggggagcttcagctgtggtagagaagacaggattcaggacaatctccagcatggccggcttccctctcctcctcaccctcctcactcactgtacagggtcctgggcccagtctgtgctgactcagccaccctcagcgtctgggacccccggacagagggtcaccatctcttgttctggaagcagttccaacatcggaagtaattctgtattctggtaccagcagctcccaggatcggcccccaaattgctcatctatatgaataatcaacggccctttggggtccctgaccgattctctggctccaagtctgacacctcagcctccctggccatcagtgggctccggtccgaggatgaggctgattattactgtgcagcatgggatgacagtcatgtgcttttcggcggagggaccaaggtgaccgtcctaggtcagcccaaggctgccccctcggtccta

SEQ ID NO: 574813 - DNA, 488 bp, Homo sapiens
  misc_feature: HIJSMM301BSTRO.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcaggacccaggctattgatgaggctgtctacttctgtcaggcgtgggacaacagcgtggtgttcggcggagggaccagtctgaccgtcttaggtcagcccaa

SEQ ID NO: 574814 - DNA, 534 bp, Homo sapiens
  misc_feature: HIJSMM301DE68M.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcacgcagcactcaagtcttcggtaacgtaggtaccgaacggtacgacccgtccgtacggtacgtacgacccgaacggacccaacccccaaccctcgttcgta

SEQ ID NO: 574815 - DNA, 454 bp, Homo sapiens
  misc_feature: HIJSMM301D1QOY.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctttcccgccctcccccacgacgagta

SEQ ID NO: 574816 - DNA, 517 bp, Homo sapiens; identical to SEQ ID NO: 469285
  misc_feature: HIJSMM301BOQN7.46.67.G01.1.454.light.4.raw

SEQ ID NO: 574817 - DNA, 505 bp, Homo sapiens; identical to SEQ ID NO: 537117
  misc_feature: HIJSMM301C7V3H.8.28.C06.1.454.light.4.raw

SEQ ID NO: 574818 - DNA, 497 bp, Homo sapiens
  misc_feature: HIJSMM301BOF62.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccttgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 574819 - DNA, 488 bp, Homo sapiens
  misc_feature: HIJSMM301CK56G.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgatttgcaacttattactgccaacagtatcatcatcattgtaattcggtgagggaccaaggtggaggtcaaacgaactgtggctgcaccatctgtcttcatt

SEQ ID NO: 574820 - DNA, 490 bp, Homo sapiens; identical to SEQ ID NO: 535234
  misc_feature: HIJSMM301C07XP.17.21.B10.1.454.light.4.raw

SEQ ID NO: 574821 - DNA, 485 bp, Homo sapiens; identical to SEQ ID NO: 536576
  misc_feature: HIJSMM301EIDKM.46.35.D02.1.454.light.4.raw

SEQ ID NO: 574822 - DNA, 505 bp, Homo sapiens; identical to SEQ ID NO: 539292
  misc_feature: HIJSMM301DXMQL.19.85.H08.1.454.light.4.raw

SEQ ID NO: 574823 - DNA, 508 bp, Homo sapiens
  misc_feature: HIJSMM301EQ2K5.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaatcaaacgaaactgtggctgcaccatctgtctt

SEQ ID NO: 574824 - DNA, 512 bp, Homo sapiens
  misc_feature: HIJSMM301D3RNV.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggtcggagggaccgaaggtaggaggtcgtaaacgaactacgtggcgtgcaccatctgtcttcta

SEQ ID NO: 574825 - DNA, 474 bp, Homo sapiens
  misc_feature: HIJSMM301DHHQD.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagtattttgctaacttactactgtcaacagagtttcagtatcccttggactttcggccaagggaccaaggtggaaatcaaacgaa

SEQ ID NO: 574826 - DNA, 475 bp, Homo sapiens
  misc_feature: HIJSMM301CQ26V.3.2.A02.1.454.light.4.raw
agacgcactccacgaccggtgctcgatttagactcatctacaggggagtcagtctcagtcaggacacagcatggacatgagggtccccgctcagctcctggggctcctgctactctggctccgaggtgccagatgtgacatccagatgacccagtctccttcctccctgtctgcatctgtgggagacagagtcaccctcacttgccggccaagtcacagcattagcatctatttaaattggtatcaacagaagccagggaaagcccctaacctcctgatctatactgcatccagtttgcaaagtggagtcccatcaaggttcagtggcagtggatctgggacagagttcactctcaccatcagcagtctgcaacctgaagattttgcaacttactactgtcaacagagttacagtatccctccaaccttcggcggaggaccaaggtggagatcaaacgaactgtggctgcaccat

SEQ ID NO: 574827 - DNA, 416 bp, Homo sapiens; identical to SEQ ID NO: 536892
  misc_feature: HIJSMM301BAW5K.16.46.E02.1.454.light.4.raw

SEQ ID NO: 574828 - DNA, 493 bp, Homo sapiens; identical to SEQ ID NO: 540693
  misc_feature: HIJSMM301EVPEI.22.65.F10.1.454.light.4.raw

SEQ ID NO: 574829 - DNA, 489 bp, Homo sapiens
  misc_feature: HIJSMM301AST22.5.15.B04.1.454.light.4.raw
atcagacacgcacgaccggtgctcgatttagacagtatatatccgcggggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtgggtcccaccaacgttcagcggcagtggatctgggacagaattcactctcaccatcagcagcctgcagcctgatgatgctgctaacttattactgtacaacaatataactagttattggacgttcggaccaagggtaccaaggtaggaaatacaaacgtaacgtgtggcgtcgcaccta

SEQ ID NO: 574830 - DNA, 479 bp, Homo sapiens; identical to SEQ ID NO: 535665
  misc_feature: HIJSMM301AONO2.12.10.A10.1.454.light.4.raw

SEQ ID NO: 574831 - DNA, 504 bp, Homo sapiens
  misc_feature: HIJSMM301AWO9K.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccatgtca

SEQ ID NO: 574832 - DNA, 499 bp, Homo sapiens
  misc_feature: HIJSMM301EUBZ4.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccaaactgaccgtcctaggtcagcccaaggctgccccccg

SEQ ID NO: 574833 - DNA, 481 bp, Homo sapiens; identical to SEQ ID NO: 541494
  misc_feature: HIJSMM301BBQR7.51.76.G10.1.454.light.4.raw

SEQ ID NO: 574834 - DNA, 497 bp, Homo sapiens
  misc_feature: HIJSMM301C2WPY.21.8.A08.1.454.light.4.raw
tcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcagggacagtggccaccttgactatcagtgggcccaggtggacgatgaagctgactactattgttacgcaccagacagtagtggtcatcagggggtattcggcggagggaccaagttgaccgtccttggtcagcccaaggctgcccctcggtcactctcg

SEQ ID NO: 574835 - DNA, 503 bp, Homo sapiens
  misc_feature: HIJSMM301EG2Z2.48.57.F02.1.454.light.4.raw
agtatacatacacgaccggtgctcgatttagctcgatatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcgggcggagggaccaaggctgaccgtcctaagtcagccaaggctgccccctggtcactctcg

SEQ ID NO: 574836 - DNA, 477 bp, Homo sapiens; identical to SEQ ID NO: 535266
  misc_feature: HIJSMM301DGNGE.4.34.D01.1.454.light.4.raw

SEQ ID NO: 574837 - DNA, 480 bp, Homo sapiens
  misc_feature: HIJSMM301BHNNJ.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgctagtttattactgtcagcactataataactggcctccgtacagttttggccagggaccaagctggagatcaaacgaa

SEQ ID NO: 574838 - DNA, 495 bp, Homo sapiens; identical to SEQ ID NO: 535007
  misc_feature: HIJSMM301DXB7V.22.5.A05.1.454.light.4.raw

SEQ ID NO: 574839 - DNA, 500 bp, Homo sapiens
  misc_feature: HIJSMM301CRFXM.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaacccc

SEQ ID NO: 574840 - DNA, 498 bp, Homo sapiens
  misc_feature: HIJSMM301DJ7KA.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttatagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacc

SEQ ID NO: 574841 - DNA, 498 bp, Homo sapiens; identical to SEQ ID NO: 537020
  misc_feature: HIJSMM301CCM1X.26.26.C04.1.454.light.4.raw

SEQ ID NO: 574842 - DNA, 492 bp, Homo sapiens
  misc_feature: HIJSMM301E0TGY.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcaccatctgtcttc

SEQ ID NO: 574843 - DNA, 480 bp, Homo sapiens; identical to SEQ ID NO: 535291
  misc_feature: HIJSMM301DE9RV.22.59.F04.1.454.light.4.raw

SEQ ID NO: 574844 - DNA, 498 bp, Homo sapiens
  misc_feature: HIJSMM301ERLIE.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggaccaaactgaccgtctaggtcagccc

SEQ ID NO: 574845 - DNA, 485 bp, Homo sapiens; identical to SEQ ID NO: 536799
  misc_feature: HIJSMM301B9CM1.19.71.G05.1.454.light.4.raw

SEQ ID NO: 574846 - DNA, 502 bp, Homo sapiens; identical to SEQ ID NO: 536584
  misc_feature: HIJSMM301AR5XP.14.57.F02.1.454.light.4.raw

SEQ ID NO: 574847 - DNA, 494 bp, Homo sapiens; identical to SEQ ID NO: 534992
  misc_feature: HIJSMM301DF86H.9.1.A01.1.454.light.4.raw

SEQ ID NO: 574848 - DNA, 488 bp, Homo sapiens; identical to SEQ ID NO: 545628
  misc_feature: HIJSMM301E22J0.14.55.E11.1.454.light.4.raw

SEQ ID NO: 574849 - DNA, 492 bp, Homo sapiens
  misc_feature: HIJSMM301AIG9U.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaggtcaccgtccg

SEQ ID NO: 574850 - DNA, 494 bp, Homo sapiens; identical to SEQ ID NO: 534992
  misc_feature: HIJSMM301A02IE.9.1.A01.1.454.light.4.raw

SEQ ID NO: 574851 - DNA, 504 bp, Homo sapiens; identical to SEQ ID NO: 555616
  misc_feature: HIJSMM301COLXG.5.86.H09.1.454.light.4.raw

SEQ ID NO: 574852 - DNA, 490 bp, Homo sapiens
  misc_feature: HIJSMM301D5MT6.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaaactgtggctgcaccatctgtcttcta

SEQ ID NO: 574853 - DNA, 490 bp, Homo sapiens
  misc_feature: HIJSMM301EXRX9.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccgaacggtggaactacaaacgaa

SEQ ID NO: 574854 - DNA, 486 bp, Homo sapiens; identical to SEQ ID NO: 537617
  misc_feature: HIJSMM301BI7H6.10.53.E09.1.454.light.4.raw

SEQ ID NO: 574855 - DNA, 473 bp, Homo sapiens
  misc_feature: HIJSMM301B3YVZ.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggcctgggactgaagtgcatatgagagaactgtggctgca

SEQ ID NO: 574856 - DNA, 514 bp, Homo sapiens
  misc_feature: HIJSMM301CP9EI.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctcctaaccatctctgggctccagtttgaggacgagtctacttattactgcagttcctttaaattaggcgccactctcgtggttttcgcggaggcaccgaagtgaccgtcctcggtcagcccaaggctgccccctcggtcactcttcg

SEQ ID NO: 574857 - DNA, 521 bp, Homo sapiens; identical to SEQ ID NO: 549643
  misc_feature: HIJSMM301DZRDD.10.86.H09.1.454.light.4.raw

SEQ ID NO: 574858 - DNA, 525 bp, Homo sapiens
  misc_feature: HIJSMM301CLV5C.49.73.G07.1.454.light.4.raw
  modified_base (498)..(498): a, c, t, g, unknown or other
agtcgagagacacgaccggtgctcgatttagctctacgctcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgtattttctggctccaagtctgggaacacggccaccctgaccgtcagcagggtcgaagccgggatgaggccgactatatctgtcaggtgtgggatagtagtagtgctcgttccgggggtgttcggcggagggaccaagttgaccgtcgttggtcagcccaaggctcgccccctcggtacnctctcgttcccgcctcctctctctcgt

SEQ ID NO: 574859 - DNA, 500 bp, Homo sapiens
  misc_feature: HIJSMM301BOO41.21.81.H04.1.454.light.4.raw
tcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccatgtca

SEQ ID NO: 574860 - DNA, 490 bp, Homo sapiens
  misc_feature: HIJSMM301CI2D9.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttattttgtcaacaggctaacactttcccctcactttcggcggagggaccaaggtggagatcaagcgaactgtggctgcaccatctgtctt

SEQ ID NO: 574861 - DNA, 516 bp, Homo sapiens; identical to SEQ ID NO: 552129
  misc_feature: HIJSMM301C0DYM.27.23.C01.1.454.light.4.raw

SEQ ID NO: 574862 - DNA, 504 bp, Homo sapiens; identical to SEQ ID NO: 535561
  misc_feature: HIJSMM301CWVBU.4.57.F02.1.454.light.4.raw

SEQ ID NO: 574863 - DNA, 506 bp, Homo sapiens
  misc_feature: HIJSMM301CVJT3.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcgggagggaccaagctgaccgtcctacgtcagcccaaggctgccccctcggtcactctgttcccccg

SEQ ID NO: 574864 - DNA, 502 bp, Homo sapiens; identical to SEQ ID NO: 542090
  misc_feature: HIJSMM301ASWVH.2.76.G10.1.454.light.4.raw

SEQ ID NO: 574865 - DNA, 519 bp, Homo sapiens
  misc_feature: HIJSMM301DAZQS.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccaccctcct

SEQ ID NO: 574866 - DNA, 507 bp, Homo sapiens
  misc_feature: HIJSMM301CPC0H.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccaccgtggaaatcaaacgaactgtggctgcaccatctgtctt

SEQ ID NO: 574867 - DNA, 476 bp, Homo sapiens; identical to SEQ ID NO: 546088
  misc_feature: HIJSMM301BNGU1.13.71.G05.1.454.light.4.raw

SEQ ID NO: 574868 - DNA, 494 bp, Homo sapiens; identical to SEQ ID NO: 536974
  misc_feature: HIJSMM301CLSPK.16.86.H09.1.454.light.4.raw

SEQ ID NO: 574869 - DNA, 492 bp, Homo sapiens; identical to SEQ ID NO: 558606
  misc_feature: HIJSMM301DL64C.16.53.E09.1.454.light.4.raw

SEQ ID NO: 574870 - DNA, 494 bp, Homo sapiens; identical to SEQ ID NO: 534992
  misc_feature: HIJSMM301ALBVG.9.1.A01.1.454.light.4.raw

SEQ ID NO: 574871 - DNA, 443 bp, Homo sapiens
  misc_feature: HIJSMM301AIN3X.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctcgacacgcag

SEQ ID NO: 574872 - DNA, 509 bp, Homo sapiens
  misc_feature: HIJSMM301CC57N.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttccttctttcaagatattcggcggagggaccacggctgacccgtcctcgagtcagcccaaggctgtcccccccg

SEQ ID NO: 574873 - DNA, 489 bp, Homo sapiens
  misc_feature: HIJSMM301BE1VG.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactagtggctgcaccat

SEQ ID NO: 574874 - DNA, 485 bp, Homo sapiens
  misc_feature: HIJSMM301C490A.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtgatatcagacgaa

SEQ ID NO: 574875 - DNA, 480 bp, Homo sapiens; identical to SEQ ID NO: 535409
  misc_feature: HIJSMM301DCRU4.4.74.G08.1.454.light.4.raw

SEQ ID NO: 574876 - DNA, 508 bp, Homo sapiens
  misc_feature: HIJSMM301ED04C.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatatacgaggacgttcggtcaagggaccaaggtggaggatcaaaacgaaactgtggctgcaccatctgtcttcatcttcccgccact

SEQ ID NO: 574877 - DNA, 506 bp, Homo sapiens
  misc_feature: HIJSMM301BWTN3.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtgaccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccagggggaccaaacgtcggtaggatactagaacggaactac

SEQ ID NO: 574878 - DNA, 493 bp, Homo sapiens
  misc_feature: HIJSMM301EAHBP.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgtttcggcggaggaccaagctgaccgtctaggtcagcccaaggctgccccc

SEQ ID NO: 574879 - DNA, 506 bp, Homo sapiens; identical to SEQ ID NO: 535058
  misc_feature: HIJSMM301DHLRN.17.41.D08.1.454.light.4.raw

SEQ ID NO: 574880 - DNA, 504 bp, Homo sapiens; identical to SEQ ID NO: 535561
  misc_feature: HIJSMM301D54KH.4.57.F02.1.454.light.4.raw

SEQ ID NO: 574881 - DNA, 478 bp, Homo sapiens
  misc_feature: HIJSMM301A68JE.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatccttcccgccatctgaagtatagtct

SEQ ID NO: 574882 - DNA, 492 bp, Homo sapiens; identical to SEQ ID NO: 536360
  misc_feature: HIJSMM301AP2BG.11.81.H04.1.454.light.4.raw

SEQ ID NO: 574883 - DNA, 483 bp, Homo sapiens; identical to SEQ ID NO: 545893
  misc_feature: HIJSMM301EPHWT.3.38.D05.1.454.light.4.raw

SEQ ID NO: 574884 - DNA, 486 bp, Homo sapiens; identical to SEQ ID NO: 535385
  misc_feature: HIJSMM301BTAR9.19.71.G05.1.454.light.4.raw

SEQ ID NO: 574885 - DNA, 501 bp, Homo sapiens
  misc_feature: HIJSMM301CX1CT.48.33.C11.1.454.light.4.raw
  modified_base (235)..(235): a, c, t, g, unknown or other
agtatacatacacgaccggtgctcgatttagagtgagctcgttgggtttggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatntgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 574886 - DNA, 493 bp, Homo sapiens
  misc_feature: HIJSMM301D6APZ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccggcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccg

SEQ ID NO: 574887 - DNA, 501 bp, Homo sapiens; identical to SEQ ID NO: 536142
  misc_feature: HIJSMM301EUFSD.15.1.A01.1.454.light.4.raw

SEQ ID NO: 574888 - DNA, 493 bp, Homo sapiens; identical to SEQ ID NO: 548342
  misc_feature: HIJSMM301CE3VE.27.78.H01.1.454.light.4.raw

SEQ ID NO: 574889 - DNA, 469 bp, Homo sapiens
  misc_feature: HIJSMM301C47EG.48.30.C08.1.454.light.4.raw
agtatacatacacgaccggtgctcgatttagtctgacgtcaaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaag

SEQ ID NO: 574890 - DNA, 417 bp, Homo sapiens
  misc_feature: HIJSMM301A28GB.18.78.H01.1.454.light.4.raw
tacgagtatgcacgaccggtgctcgatttagtgtgagtagtttgggtttgggggcgtttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgtaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccacctcctccatactcgta

SEQ ID NO: 574891 - DNA, 489 bp, Homo sapiens; identical to SEQ ID NO: 546186
  misc_feature: HIJSMM301BV6FP.52.85.H08.1.454.light.4.raw

SEQ ID NO: 574892 - DNA, 485 bp, Homo sapiens; identical to SEQ ID NO: 536576
  misc_feature: HIJSMM301C59KY.46.35.D02.1.454.light.4.raw

SEQ ID NO: 574893 - DNA, 477 bp, Homo sapiens
  misc_feature: HIJSMM301EMKK9.52.22.B11.1.454.light.4.raw
cgcagtacgacacgaccggtgctcgatttagacgacagctcaggggcagtctcagtcaggacacagcatggacatgagggtccccgctcagctcctggggctcctgctactctggctcctaggtgccagatgtgtcatccagatgacccagtctccatcctccctgtccgcatctgtaggagacagagtcatcatcacttgccgggcaagtcagagcattagaacgtatttaaattgttatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtctt

SEQ ID NO: 574894 - DNA, 460 bp, Homo sapiens; identical to SEQ ID NO: 537107
  misc_feature: HIJSMM301CH7L3.22.28.C06.1.454.light.4.raw

SEQ ID NO: 574895 - DNA, 520 bp, Homo sapiens
  misc_feature: HIJSMM301E3MUS.11.57.F02.1.454.light.4.raw
  modified_base (485)..(485): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaacgggacgaacggtaggaagtacgaagcgacagtggntgcaccatctgtcttctactcttcccgtcccactt

SEQ ID NO: 574896 - DNA, 441 bp, Homo sapiens; identical to SEQ ID NO: 550529
  misc_feature: HIJSMM301ECJ0C.41.9.A09.1.454.light.4.raw

SEQ ID NO: 574897 - DNA, 512 bp, Homo sapiens
  misc_feature: HIJSMM301AJ11S.43.67.G01.1.454.light.4.raw
tgtgagtagtcacgaccggtgctcgatttagagtatacatattgggtttgggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcgccggggaccgaccgtcggaaatacaaacgaactacgtggctgcaccatctgtcttcta

SEQ ID NO: 574898 - DNA, 503 bp, Homo sapiens
  misc_feature: HIJSMM301C0B77.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaacccactgtcactctgttcccgccct

SEQ ID NO: 574899 - DNA, 454 bp, Homo sapiens; identical to SEQ ID NO: 534964
  misc_feature: HIJSMM301BE4CN.19.86.H09.1.454.light.4.raw

SEQ ID NO: 574900 - DNA, 488 bp, Homo sapiens; identical to SEQ ID NO: 535861
  misc_feature: HIJSMM301BGOWS.14.55.E11.1.454.light.4.raw

SEQ ID NO: 574901 - DNA, 486 bp, Homo sapiens; identical to SEQ ID NO: 544919
  misc_feature: HIJSMM301C1U7U.7.85.H08.1.454.light.4.raw

SEQ ID NO: 574902 - DNA, 488 bp, Homo sapiens; identical to SEQ ID NO: 535990
  misc_feature: HIJSMM301CSMXL.11.28.C06.1.454.light.4.raw

SEQ ID NO: 574903 - DNA, 505 bp, Homo sapiens; identical to SEQ ID NO: 566747
  misc_feature: HIJSMM301AQQG9.12.48.E04.1.454.light.4.raw

SEQ ID NO: 574904 - DNA, 499 bp, Homo sapiens
  misc_feature: HIJSMM301ERP2O.43.37.D04.1.454.light.4.raw
tgtgagtagtcacgaccggtgctcgatttagtagcatactgttgggtttggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagaccccg

SEQ ID NO: 574905 - DNA, 480 bp, Homo sapiens
  misc_feature: HIJSMM301D1JG6.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccaggggacgaaggtcgaaatgagacgaactgtggctgcacc

SEQ ID NO: 574906 - DNA, 493 bp, Homo sapiens
  misc_feature: HIJSMM301CTH5S.10.28.C06.1.454.light.4.raw
catagtagtgcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccaagggggacgggatccctgatcgtttttcagggtccagctctggggctgagcgctacctcaccatctccacgcctccagtctgaggatgaggctgactattactgtcagacctgggcgactggttatgtggttttcggtcggtagggacgaagactgaccgtcctacggtcgagccaacggcgtccg

SEQ ID NO: 574907 - DNA, 494 bp, Homo sapiens; identical to SEQ ID NO: 539894
  misc_feature: HIJSMM301BV6Y9.16.53.E09.1.454.light.4.raw

SEQ ID NO: 574908 - DNA, 476 bp, Homo sapiens; identical to SEQ ID NO: 538026
  misc_feature: HIJSMM301BYOSA.13.76.G10.1.454.light.4.raw

SEQ ID NO: 574909 - DNA, 446 bp, Homo sapiens
  misc_feature: HIJSMM301CQ79M.9.9.A09.1.454.light.4.raw
tgatacgtctcacgaccggtgctcgatttagcgagacgcgcagggtccgtgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgatttattactgccactcctatgacagcagcctgagaagtgtggtattcggcggagggaccaagctgaccgtcctaggtcagcccaaggctgccccctcggtcactctgttcccaccctcctcagacgtactca

SEQ ID NO: 574910 - DNA, 508 bp, Homo sapiens
  misc_feature: HIJSMM301B1BW9.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgtcccg

SEQ ID NO: 574911 - DNA, 497 bp, Homo sapiens
  misc_feature: HIJSMM301BFXGO.3.33.C11.1.454.light.4.raw
agacgcactccacgaccggtgctcgatttagagtgagctcgttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccccc

SEQ ID NO: 574912 - DNA, 503 bp, Homo sapiens
  misc_feature: HIJSMM301EW0UQ.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactccctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaa

SEQ ID NO: 574913 - DNA, 475 bp, Homo sapiens; identical to SEQ ID NO: 551399
  misc_feature: HIJSMM301CCU42.4.79.H02.1.454.light.4.raw

SEQ ID NO: 574914 - DNA, 476 bp, Homo sapiens; identical to SEQ ID NO: 537368
  misc_feature: HIJSMM301DZSK6.7.83.H06.1.454.light.4.raw

SEQ ID NO: 574915 - DNA, 502 bp, Homo sapiens
  misc_feature: HIJSMM301AJSUU.9.53.E09.1.454.light.4.raw
tgatacgtctcacgaccggtgctcgatttagagagagtgtgttgggtttggggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtggccgtcctaggtcagcccaaggctgcccccc

SEQ ID NO: 574916 - DNA, 492 bp, Homo sapiens
  misc_feature: HIJSMM301C2JXT.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggttattactgcatgcaagctctacaaactccttacacttttggccaggggaccaaagctggagatcaaacgaaactgt

SEQ ID NO: 574917 - DNA, 491 bp, Homo sapiens; identical to SEQ ID NO: 539402
  misc_feature: HIJSMM301D9UIC.13.5.A05.1.454.light.4.raw

SEQ ID NO: 574918 - DNA, 486 bp, Homo sapiens
  misc_feature: HIJSMM301CXPVN.49.57.F02.1.454.light.4.raw
agtcgagagacacgaccggtgctcgatttagctcgatatagttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctcg

SEQ ID NO: 574919 - DNA, 500 bp, Homo sapiens; identical to SEQ ID NO: 542309
  misc_feature: HIJSMM301ASY9R.12.86.H09.1.454.light.4.raw

SEQ ID NO: 574920 - DNA, 498 bp, Homo sapiens; identical to SEQ ID NO: 537020
  misc_feature: HIJSMM301CASHG.26.26.C04.1.454.light.4.raw

SEQ ID NO: 574921 - DNA, 490 bp, Homo sapiens
  misc_feature: HIJSMM301D38JV.48.38.D05.1.454.light.4.raw
agtatacatacacgaccggtgctcgatttagtatctgatagttgggtttgggggtgggtccaggaggcagaactctgggtgtctcaccatggcctggatccctctacttctcccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccg

SEQ ID NO: 574922 - DNA, 505 bp, Homo sapiens; identical to SEQ ID NO: 536254
  misc_feature: HIJSMM301DT6K8.7.71.G05.1.454.light.4.raw

SEQ ID NO: 574923 - DNA, 525 bp, Homo sapiens
  misc_feature: HIJSMM301AURMF.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaagggaccgaacggtaggaaggtacgaaacgaacctagtaggcgtgcgaccatcctcgtcttctactcttcccgtcccact

SEQ ID NO: 574924 - DNA, 487 bp, Homo sapiens
  misc_feature: HIJSMM301A936S.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggaggatcaaacgaactagtggctgcaccatctgtt

SEQ ID NO: 574925 - DNA, 509 bp, Homo sapiens; identical to SEQ ID NO: 541829
  misc_feature: HIJSMM301DSR3E.17.28.C06.1.454.light.4.raw

SEQ ID NO: 574926 - DNA, 495 bp, Homo sapiens
  misc_feature: HIJSMM301DP872.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggcccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagatttgctagtttattactgtcagcactataataactggcctccgtactagttttggccaggggaccaagcgtggagagtacaaacgaactgtggctcg

SEQ ID NO: 574927 - DNA, 487 bp, Homo sapiens
  misc_feature: HIJSMM301C3A5Q.5.34.D01.1.454.light.4.raw
atcagacacgcacgaccggtgctcgatttagatcgtctgtgttggggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaagggacacgactggagattaaacgaactagtggctgcaccta

SEQ ID NO: 574928 - DNA, 495 bp, Homo sapiens; identical to SEQ ID NO: 535596
  misc_feature: HIJSMM301BN6RZ.10.79.H02.1.454.light.4.raw

SEQ ID NO: 574929 - DNA, 492 bp, Homo sapiens
  misc_feature: HIJSMM301BYBFB.9.19.B08.1.454.light.4.raw
  modified_base (450)..(450): a, c, t, g, unknown or other
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcgggcaggttatgatgtccactggtaccagcagtttccaggaacagtccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggngttcggcggagggaccaagctgaccgtcctcagtcagccccg

SEQ ID NO: 574930 - DNA, 447 bp, Homo sapiens; identical to SEQ ID NO: 535020
  misc_feature: HIJSMM301EV9FH.18.9.A09.1.454.light.4.raw

SEQ ID NO: 574931 - DNA, 492 bp, Homo sapiens; identical to SEQ ID NO: 564874
  misc_feature: HIJSMM301BLWEF.11.25.C03.1.454.light.4.raw

SEQ ID NO: 574932 - DNA, 487 bp, Homo sapiens; identical to SEQ ID NO: 558255
  misc_feature: HIJSMM301CADJG.12.33.C11.1.454.light.4.raw

SEQ ID NO: 574933 - DNA, 488 bp, Homo sapiens; identical to SEQ ID NO: 535725
  misc_feature: HIJSMM301CYZA5.12.88.H11.1.454.light.4.raw

SEQ ID NO: 574934 - DNA, 482 bp, Homo sapiens
  misc_feature: HIJSMM301ERZAF.11.11.A11.1.454.light.4.raw
  modified_base (395)..(395): a, c, t, g, unknown or other
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaaccaggacagcctcctaaactgctcatctcctgggcatctacccgggcacccggagtccctgaccgattcagtggcagcgggtctgggacagacttcactctcaccatcagcaaacctgcaggctgaagatgtggcagtttattacngtcagcagtattgtgaagctccgctcactttcggcggagggaccgcggtggagatcaagacgaaactgtggctgcaccatctgtctt

SEQ ID NO: 574935 - DNA, 514 bp, Homo sapiens; identical to SEQ ID NO: 560276
  misc_feature: HIJSMM301BJWIJ.15.86.H09.1.454.light.4.raw

SEQ ID NO: 574936 - DNA, 487 bp, Homo sapiens; identical to SEQ ID NO: 560173
  misc_feature: HIJSMM301A8Z98.47.70.G04.1.454.light.4.raw

SEQ ID NO: 574937 - DNA, 506 bp, Homo sapiens
  misc_feature: HIJSMM301BG9QP.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctacaccatctgtctt

SEQ ID NO: 574938 - DNA, 496 bp, Homo sapiens; identical to SEQ ID NO: 555279
  misc_feature: HIJSMM301CK3KD.4.3.A03.1.454.light.4.raw

SEQ ID NO: 574939 - DNA, 486 bp, Homo sapiens; identical to SEQ ID NO: 535043
  misc_feature: HIJSMM301B0LWR.46.35.D02.1.454.light.4.raw

SEQ ID NO: 574940 - DNA, 497 bp, Homo sapiens; identical to SEQ ID NO: 545672
  misc_feature: HIJSMM301A9B65.2.49.E05.1.454.light.4.raw

SEQ ID NO: 574941 - DNA, 486 bp, Homo sapiens
  misc_feature: HIJSMM301ESR3H.49.83.H06.1.454.light.4.raw
agtcgagagacacgaccggtgctcgatttagatcacgtgcgtcgcggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccgacggtggagatcaaacgaactagtggctgcaccta

SEQ ID NO: 574942 - DNA, 497 bp, Homo sapiens
  misc_feature: HIJSMM301A4OQN.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaagg

SEQ ID NO: 574943 - DNA, 485 bp, Homo sapiens; identical to SEQ ID NO: 536075
  misc_feature: HIJSMM301BCGI5.17.21.B10.1.454.light.4.raw

SEQ ID NO: 574944 - DNA, 508 bp, Homo sapiens; identical to SEQ ID NO: 550380
  misc_feature: HIJSMM301C410E.4.57.F02.1.454.light.4.raw

SEQ ID NO: 574945 - DNA, 487 bp, Homo sapiens; identical to SEQ ID NO: 538190
  misc_feature: HIJSMM301DYCEX.47.70.G04.1.454.light.4.raw

SEQ ID NO: 574946 - DNA, 497 bp, Homo sapiens
  misc_feature: HIJSMM301B2PYF.11.81.H04.1.454.light.4.raw
  modified_base (404)..(404): a, c, t, g, unknown or other
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttacngtcagcagtatagtaactggcctccgtacacttttggccagggaccgaagactagaaatacaaacgaactgtggctgcaccatctgtcttcta

SEQ ID NO: 574947 - DNA, 484 bp, Homo sapiens; identical to SEQ ID NO: 536395
  misc_feature: HIJSMM301DBVGA.46.35.D02.1.454.light.4.raw

SEQ ID NO: 574948 - DNA, 491 bp, Homo sapiens; identical to SEQ ID NO: 535194
  misc_feature: HIJSMM301EL1CB.26.78.H01.1.454.light.4.raw

SEQ ID NO: 574949 - DNA, 488 bp, Homo sapiens
  misc_feature: HIJSMM301BO61L.13.59.F04.1.454.light.4.raw
tcacgtactacacgaccggtgctcgatttagtacacacacttagggattggggggcagaagtctctctcagtcaggacacagcaatggacatgagggtccctgctcagctcctgggactcctgctgctctggctcccagataccagatgtgacatccagatgacccagtctccagtcctccctgtcctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 574950 - DNA, 505 bp, Homo sapiens
  misc_feature: HIJSMM301BHYEK.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcacttcc

SEQ ID NO: 574951 - DNA, 496 bp, Homo sapiens
  misc_feature: HIJSMM301BA05A.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtccaggtcagcccaaggccaa

SEQ ID NO: 574952 - DNA, 500 bp, Homo sapiens
  misc_feature: HIJSMM301BRH8B.15.25.C03.1.454.light.4.raw
tctacgtagccacgaccggtgctcgatttagtagtgtagatttgggtttgggggatcaggactcctcatttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactagaaaatcagcagagtggaggctgaggacggttggggtttattactgcatgcaaggtctacaaccccgatcaccttcggccgagggacacgcctggagaattaaacgaactgtggctgcaccat

SEQ ID NO: 574953 - DNA, 508 bp, Homo sapiens; identical to SEQ ID NO: 536388
  misc_feature: HIJSMM301DMB2P.11.57.F02.1.454.light.4.raw

SEQ ID NO: 574954 - DNA, 493 bp, Homo sapiens; identical to SEQ ID NO: 539187
  misc_feature: HIJSMM301DLXO6.14.30.C08.1.454.light.4.raw

SEQ ID NO: 574955 - DNA, 497 bp, Homo sapiens
  misc_feature: HIJSMM301A9CCR.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 574956 - DNA, 499 bp, Homo sapiens
  misc_feature: HIJSMM301AJS4Z.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtaggaaatcaaacgaactgtggctgcacc

SEQ ID NO: 574957 - DNA, 495 bp, Homo sapiens; identical to SEQ ID NO: 546624
  misc_feature: HIJSMM301C0JDJ.52.38.D05.1.454.light.4.raw

SEQ ID NO: 574958 - DNA, 453 bp, Homo sapiens
  misc_feature: HIJSMM301BONLW.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 574959 - DNA, 454 bp, Homo sapiens; identical to SEQ ID NO: 535005
  misc_feature: HIJSMM301AQCHP.19.86.H09.1.454.light.4.raw

SEQ ID NO: 574960 - DNA, 478 bp, Homo sapiens
  misc_feature: HIJSMM301C0SRD.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttttagcctggtatcagcagaaaccagggaaagttccacacctcctgatctatgctgcatccgctttgcaatcagggtcccatctcggttcagcggcagtggatctgggacagagttcactctcaccatcagcagcctgcagcctgaagatgttgcaacttattactgtacaaaagtataacagtcgccccccttcacccttcggccaagggacacgactggagattagaacg

SEQ ID NO: 574961 - DNA, 484 bp, Homo sapiens
  misc_feature: HIJSMM301CXK3E.48.45.E01.1.454.light.4.raw
agtatacatacacgaccggtgctcgatttagtgagtcagtaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgatactggcctccgtcaccttcggcggcgggaccaaggtggagatcaaacgactgtggctgcacat

SEQ ID NO: 574962 - DNA, 504 bp, Homo sapiens; identical to SEQ ID NO: 550663
  misc_feature: HIJSMM301EMWUI.18.78.H01.1.454.light.4.raw

SEQ ID NO: 574963 - DNA, 499 bp, Homo sapiens; identical to SEQ ID NO: 545133
  misc_feature: HIJSMM301AUN7E.48.83.H06.1.454.light.4.raw

SEQ ID NO: 574964 - DNA, 443 bp, Homo sapiens
  misc_feature: HIJSMM301CJQY9.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatact

SEQ ID NO: 574965 - DNA, 489 bp, Homo sapiens
  misc_feature: HIJSMM301B37NW.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatcccccccaccactcagcacgccttagcctggtaccagcacaagtcagggcagcctcctaagttgctctttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggacctaagttggagatacaaacgaa

SEQ ID NO: 574966 - DNA, 499 bp, Homo sapiens
  misc_feature: HIJSMM301AVKGK.15.25.C03.1.454.light.4.raw
tctacgtagccacgaccggtgctcgatttagtagtgtagatttgggtttgggggatcaggactcctcatttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacacttgaaaatcagcagagtggaggctgaggacgttggggtttattactgcatgcaaggtctacaaaccccgatcaccttcggccgagggacacgcctggagattaaacgaactgtggctgcaccat

SEQ ID NO: 574967 - DNA, 520 bp, Homo sapiens
  misc_feature: HIJSMM301D65Z0.10.86.H09.1.454.light.4.raw
catagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgtggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactcaacctgactgttggggctttcggcggagggactaagttgaccgtcctacgtcagcccaaggctgccccctcggtcact

SEQ ID NO: 574968 - DNA, 526 bp, Homo sapiens
  misc_feature: HIJSMM301BLM2E.43.27.C05.1.454.light.4.raw
tgtgagtagtcacgaccggtgctcgatttagacgcgatcgaagggtttggggagagaagacaggattcaggacaatctccagcatggccggcttccctctcctcctcaccctcctcactcactgtgcagggtcctgggcccagtctgtactgactcagccaccctcagcgtctgggacccccgggcagagggtcaccatctcttgttctgggacctactccaacatcggaagtaattatgtttactggtaccagcagctcccaggaacggcccccaaactcctcatctataggaataatcagcggccctcaggggtccctgaccgattctctggctccaagtctggcacctcagcctccctggccatccgtgggctccggtccgaggatgaggctgattattactgtgcaacatgggatgacaccctgagtgcctatgtggttttcggcggagggaccaagctgaccgtccaaggtcagcccaaggctgccccctcggtcactctgttcccgccctcctcactact

SEQ ID NO: 574969 - DNA, 479 bp, Homo sapiens; identical to SEQ ID NO: 535188
  misc_feature: HIJSMM301BJ54I.10.74.G08.1.454.light.4.raw

SEQ ID NO: 574970 - DNA, 507 bp, Homo sapiens; identical to SEQ ID NO: 557429
  misc_feature: HIJSMM301DLNEC.15.59.F04.1.454.light.4.raw

SEQ ID NO: 574971 - DNA, 497 bp, Homo sapiens; identical to SEQ ID NO: 536371
  misc_feature: HIJSMM301AXXK2.16.78.H01.1.454.light.4.raw

SEQ ID NO: 574972 - DNA, 479 bp, Homo sapiens
  misc_feature: HIJSMM301E28ML.52.26.C04.1.454.light.4.raw
cgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaaggctgaccgtcctaggtcagcccaagg

SEQ ID NO: 574973 - DNA, 520 bp, Homo sapiens
  misc_feature: HIJSMM301C3LJ3.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggtcccgtcgggtaccgaaacgtaggaggaagtacaaaccgaaactaacgtgggtcgtgcgacccaactcttcgtcttt

SEQ ID NO: 574974 - DNA, 494 bp, Homo sapiens; identical to SEQ ID NO: 534994
  misc_feature: HIJSMM301AP6R3.27.78.H01.1.454.light.4.raw

SEQ ID NO: 574975 - DNA, 485 bp, Homo sapiens; identical to SEQ ID NO: 563465
  misc_feature: HIJSMM301DHQ23.19.71.G05.1.454.light.4.raw

SEQ ID NO: 574976 - DNA, 500 bp, Homo sapiens
  misc_feature: HIJSMM301BN6TS.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatacaaacgaactgtggctgca

SEQ ID NO: 574977 - DNA, 516 bp, Homo sapiens
  misc_feature: HIJSMM301CSAPD.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagccctctcgtggttttcggcgggggaccaaggtgaccgtcctaagtcagcccaaggctgccccctcggtcactctgttcccaccctcct

SEQ ID NO: 574978 - DNA, 478 bp, Homo sapiens; identical to SEQ ID NO: 543315
  misc_feature: HIJSMM301BJFTL.26.72.G06.1.454.light.4.raw

SEQ ID NO: 574979 - DNA, 487 bp, Homo sapiens; identical to SEQ ID NO: 536536
  misc_feature: HIJSMM301BC14U.26.45.E01.1.454.light.4.raw

SEQ ID NO: 574980 - DNA, 493 bp, Homo sapiens; identical to SEQ ID NO: 535657
  misc_feature: HIJSMM301B6MWC.27.78.H01.1.454.light.4.raw

SEQ ID NO: 574981 - DNA, 504 bp, Homo sapiens
  misc_feature: HIJSMM301C7W5Y.51.12.B01.1.454.light.4.raw
cgatcgtatacacgaccggtgctcgatttagtagtgtagattcggcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccgtcagtggagtccaggcagaggacgaggctgactattattgtcaatcaacagacaccattggtacttatgtcttcggaactgcgaccaaggtcaccgtcctgggtcagcccaaggccaaccccactcgtcactctcgttccccg

SEQ ID NO: 574982 - DNA, 501 bp, Homo sapiens; identical to SEQ ID NO: 535873
  misc_feature: HIJSMM301AIXYZ.17.27.C05.1.454.light.4.raw

SEQ ID NO: 574983 - DNA, 486 bp, Homo sapiens; identical to SEQ ID NO: 563598
  misc_feature: HIJSMM301C8M0W.14.53.E09.1.454.light.4.raw

SEQ ID NO: 574984 - DNA, 513 bp, Homo sapiens
  misc_feature: HIJSMM301ELLUP.43.67.G01.1.454.light.4.raw
tgtgagtagtcacgaccggtgctcgatttagagtatacatattgggtttgggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtggaaatacaaacgaactacgtggctgcaccatctgtcttcta

SEQ ID NO: 574985 - DNA, 493 bp, Homo sapiens; identical to SEQ ID NO: 535084
  misc_feature: HIJSMM301EK5QI.47.64.F09.1.454.light.4.raw

SEQ ID NO: 574986 - DNA, 517 bp, Homo sapiens
  misc_feature: HIJSMM301B0EH9.49.11.A11.1.454.light.4.raw
agtcgagagacacgaccggtgctcgatttagctacgactgcagggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctcctctctcg

SEQ ID NO: 574987 - DNA, 503 bp, Homo sapiens
  misc_feature: HIJSMM301C5QBF.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccactcgtcactt

SEQ ID NO: 574988 - DNA, 502 bp, Homo sapiens; identical to SEQ ID NO: 549179
  misc_feature: HIJSMM301AJTME.14.57.F02.1.454.light.4.raw

SEQ ID NO: 574989 - DNA, 495 bp, Homo sapiens
  misc_feature: HIJSMM301EALI2.52.34.D01.1.454.light.4.raw
cgcagtacgacacgaccggtgctcgatttagatcgtctgtgttggggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagccaaggccaacccactgtcactc

SEQ ID NO: 574990 - DNA, 513 bp, Homo sapiens
  misc_feature: HIJSMM301CPLG4.40.18.B07.1.454.light.4.raw
tctagcgactcacgaccggtgctcgatttagtcgctgcgtaagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggccagggtcaggcccaaggccaacccccactcgtcactctgtt

SEQ ID NO: 574991 - DNA, 511 bp, Homo sapiens
  misc_feature: HIJSMM301B0J0X.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacggggcccagccagaggatgagtcttattattactgcatgctccatgtggggggtgccacgttgggtgttcggcggagggaccaagctgaccgtccg

SEQ ID NO: 574992 - DNA, 507 bp, Homo sapiens
  misc_feature: HIJSMM301E1FKK.5.86.H09.1.454.light.4.raw
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggcctgccccctcggtccta

SEQ ID NO: 574993 - DNA, 491 bp, Homo sapiens
  misc_feature: HIJSMM301EI49J.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaactttattattgtcaacagggtaacagtttcccgctcaccttcggcggagggaccaaggtggagatagaaaagaactgtggctgcaccat

SEQ ID NO: 574994 - DNA, 514 bp, Homo sapiens; identical to SEQ ID NO: 547648
  misc_feature: HIJSMM301BM4WF.16.1.A01.1.454.light.4.raw

SEQ ID NO: 574995 - DNA, 482 bp, Homo sapiens; identical to SEQ ID NO: 541033
  misc_feature: HIJSMM301EBQ2V.4.27.C05.1.454.light.4.raw

SEQ ID NO: 574996 - DNA, 464 bp, Homo sapiens
  misc_feature: HIJSMM301EFAH1.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaagaatagcgctgcccgctcagtttcggcggagggaccaaggtggagatacg

SEQ ID NO: 574997 - DNA, 504 bp, Homo sapiens
  misc_feature: HIJSMM301DRW9C.21.22.B11.1.454.light.4.raw
  modified_base (430)..(430): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgacttattactgtgcatcacgggacncaaacatgggatgacaatctgagcggttgggtgttcggcggagggaccaaactgaccgtcctaggtcagcccaa

SEQ ID NO: 574998 - DNA, 464 bp, Homo sapiens; identical to SEQ ID NO: 539492
  misc_feature: HIJSMM301DY9M6.18.59.F04.1.454.light.4.raw

SEQ ID NO: 574999 - DNA, 481 bp, Homo sapiens; identical to SEQ ID NO: 535061
  misc_feature: HIJSMM301EQ5C9.16.81.H04.1.454.light.4.raw

SEQ ID NO: 575000 - DNA, 477 bp, Homo sapiens
  misc_feature: HIJSMM301CGVYV.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtgttttggctgttcggcggcgggc

SEQ ID NO: 575001 - DNA, 501 bp, Homo sapiens
  misc_feature: HIJSMM301A6Y3J.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggccaaccccactgtcta

SEQ ID NO: 575002 - DNA, 501 bp, Homo sapiens
  misc_feature: HIJSMM301B5XI3.27.78.H01.1.454.light.4.raw
agcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaactttattactgtcatcagagttactactttacctcaagtgatcaccttcggccaagggacacgactggagattaaacgaaactgtggctgcaccaactctgtctt

SEQ ID NO: 575003 - DNA, 511 bp, Homo sapiens
  misc_feature: HIJSMM301A2FX5.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggcccgtgggaccaaacgtaggatatcaaacgaactgtggctgcaccatctgtcttcta

SEQ ID NO: 575004 - DNA, 493 bp, Homo sapiens; identical to SEQ ID NO: 539456
  misc_feature: HIJSMM301BQ6RS.10.79.H02.1.454.light.4.raw

SEQ ID NO: 575005 - DNA, 497 bp, Homo sapiens; identical to SEQ ID NO: 535286
  misc_feature: HIJSMM301AG952.18.59.F04.1.454.light.4.raw

SEQ ID NO: 575006 - DNA, 498 bp, Homo sapiens
  misc_feature: HIJSMM301AYZ7W.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaaacgaactgtggctgcaccatctgtcttcatcttcccgccatctgac

SEQ ID NO: 575007 - DNA, 486 bp, Homo sapiens; identical to SEQ ID NO: 537238
  misc_feature: HIJSMM301CEDZR.19.71.G05.1.454.light.4.raw

SEQ ID NO: 575008 - DNA, 494 bp, Homo sapiens; identical to SEQ ID NO: 534994
  misc_feature: HIJSMM301CKTS2.27.78.H01.1.454.light.4.raw

SEQ ID NO: 575009 - DNA, 495 bp, Homo sapiens; identical to SEQ ID NO: 538269
  misc_feature: HIJSMM301AFMVX.9.1.A01.1.454.light.4.raw

SEQ ID NO: 575010 - DNA, 486 bp, Homo sapiens
  misc_feature: HIJSMM301ARRFR.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgt

SEQ ID NO: 575011 - DNA, 505 bp, Homo sapiens
  misc_feature: HIJSMM301BGASW.48.28.C06.1.454.light.4.raw
agtatacatacacgaccggtgctcgatttagagctcacgtattgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttggggtgttcggcaggagggaccaagcctgaccgtcctaggtcagcccaaggctcgccccccg

SEQ ID NO: 575012 - DNA, 504 bp, Homo sapiens
  misc_feature: HIJSMM301DY2YN.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttccttttttgtcttcggaactgggaccgaggtcaccgtcctaggtcagcccaaggccaacccactgtcta

SEQ ID NO: 575013 - DNA, 513 bp, Homo sapiens; identical to SEQ ID NO: 565866
  misc_feature: HIJSMM301DTPIZ.15.86.H09.1.454.light.4.raw

SEQ ID NO: 575014 - DNA, 447 bp, Homo sapiens; identical to SEQ ID NO: 535020
  misc_feature: HIJSMM301BBDTN.18.9.A09.1.454.light.4.raw

SEQ ID NO: 575015 - DNA, 472 bp, Homo sapiens; identical to SEQ ID NO: 535898
  misc_feature: HIJSMM301EA1ME.15.8.A08.1.454.light.4.raw

SEQ ID NO: 575016 - DNA, 503 bp, Homo sapiens
  misc_feature: HIJSMM301DRKON.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggcccaacccactgtcta

SEQ ID NO: 575017 - DNA, 510 bp, Homo sapiens; identical to SEQ ID NO: 535376
  misc_feature: HIJSMM301ADJI8.17.33.C11.1.454.light.4.raw

SEQ ID NO: 575018 - DNA, 505 bp, Homo sapiens
  misc_feature: HIJSMM301AQSNH.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccaggacgaacggtggaagtcgaacgaactagtggctgcaccatctgtcttctatcttcccgtccact

SEQ ID NO: 575019 - DNA, 462 bp, Homo sapiens
  misc_feature: HIJSMM301EKQ9L.10.40.D07.1.454.light.4.raw
catagtagtgcacgaccggtgctcgatttagtgatagagcgtaacaacagagggtccagggcccaatatgttctgacacagccgccctcagtgtccggggcccccgggcagcgggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtcccatttcctggccatcaatgggctccaggctgaagatgaggctgattactactgccagtcgtatgacaccaagctgaaactttgggtcttcggcggagggaccaggctgaccgtcctacgtcagcccaaggctgccccctcggtcactctgttcccaccctcctccactactatg

SEQ ID NO: 575020 - DNA, 501 bp, Homo sapiens
  misc_feature: HIJSMM301CSG3V.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggcctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgcccccc

SEQ ID NO: 575021 - DNA, 491 bp, Homo sapiens; identical to SEQ ID NO: 536211
  misc_feature: HIJSMM301CWVBY.16.53.E09.1.454.light.4.raw

SEQ ID NO: 575022 - DNA, 484 bp, Homo sapiens
  misc_feature: HIJSMM301EXPZR.51.60.F05.1.454.light.4.raw
cgatcgtatacacgaccggtgctcgatttagtacgtcatcagggaaagggggggcctcaggaagcagcatcggaggtgcctcagccatggcatggatccctctcttcctcggcgtccttgcttactgcacatgatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctgccccccg

SEQ ID NO: 575023 - DNA, 486 bp, Homo sapiens
  misc_feature: HIJSMM301D6QYV.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggagtaatcagacgaa

SEQ ID NO: 575024 - DNA, 495 bp, Homo sapiens
  misc_feature: HIJSMM301E1FNK.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacgatcaagacgaactagtggctgcaccatctgt

SEQ ID NO: 575025 - DNA, 494 bp, Homo sapiens
  misc_feature: HIJSMM301C3K17.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggaggaccaaggtggagatcaaacgaactgtggctgcaccatctgtcttcatcttcccgcc

SEQ ID NO: 575026 - DNA, 488 bp, Homo sapiens; identical to SEQ ID NO: 542699
  misc_feature: HIJSMM301EZ1AP.12.51.E07.1.454.light.4.raw

SEQ ID NO: 575027 - DNA, 482 bp, Homo sapiens; identical to SEQ ID NO: 560945
  misc_feature: HIJSMM301AXWNC.13.8.A08.1.454.light.4.raw

SEQ ID NO: 575028 - DNA, 490 bp, Homo sapiens; identical to SEQ ID NO: 547085
  misc_feature: HIJSMM301BMTHG.12.51.E07.1.454.light.4.raw

SEQ ID NO: 575029 - DNA, 496 bp, Homo sapiens; identical to SEQ ID NO: 565179
  misc_feature: HIJSMM301BU7WR.48.48.E04.1.454.light.4.raw

SEQ ID NO: 575030 - DNA, 485 bp, Homo sapiens; identical to SEQ ID NO: 540345
  misc_feature: HIJSMM301AHDH6.17.34.D01.1.454.light.4.raw

SEQ ID NO: 575031 - DNA, 496 bp, Homo sapiens; identical to SEQ ID NO: 536690
  misc_feature: HIJSMM301B0FUW.40.23.C01.1.454.light.4.raw

SEQ ID NO: 575032 - DNA, 489 bp, Homo sapiens; identical to SEQ ID NO: 548146
  misc_feature: HIJSMM301CWCOQ.51.6.A06.1.454.light.4.raw

SEQ ID NO: 575033 - DNA, 522 bp, Homo sapiens; identical to SEQ ID NO: 568215
  misc_feature: HIJSMM301D0NCP.27.23.C01.1.454.light.4.raw

SEQ ID NO: 575034 - DNA, 502 bp, Homo sapiens
  misc_feature: HIJSMM301AJ3ZS.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaaccccactgtca

SEQ ID NO: 575035 - DNA, 505 bp, Homo sapiens; identical to SEQ ID NO: 546412
  misc_feature: HIJSMM301BTI4R.22.21.B10.1.454.light.4.raw

SEQ ID NO: 575036 - DNA, 486 bp, Homo sapiens; identical to SEQ ID NO: 535187
  misc_feature: HIJSMM301AJC71.49.35.D02.1.454.light.4.raw

SEQ ID NO: 575037 - DNA, 510 bp, Homo sapiens
  misc_feature: HIJSMM301AIZ9M.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccaccctcc

SEQ ID NO: 575038 - DNA, 510 bp, Homo sapiens
  misc_feature: HIJSMM301CV3LV.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaagggaccgaaggtggaagtcaaacgaactagtaggctgcaccatctgtcttctactcttcccgtccact

SEQ ID NO: 575039 - DNA, 505 bp, Homo sapiens
  misc_feature: HIJSMM301AF1KR.43.42.D09.1.454.light.4.raw
tgtgagtagtcacgaccggtgctcgatttagacacatacgcagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagtattttgctaatttattactgtcaccagtatggtagctcacctctaactttcggcggagggaccgaaggtagggagatacaaacgaactgtggcgtgcaccatctgtcttcta

SEQ ID NO: 575040 - DNA, 503 bp, Homo sapiens; identical to SEQ ID NO: 538884
  misc_feature: HIJSMM301BDH3W.27.78.H01.1.454.light.4.raw

SEQ ID NO: 575041 - DNA, 473 bp, Homo sapiens; identical to SEQ ID NO: 538875
  misc_feature: HIJSMM301CPFA7.4.75.G09.1.454.light.4.raw

SEQ ID NO: 575042 - DNA, 444 bp, Homo sapiens; identical to SEQ ID NO: 535192
  misc_feature: HIJSMM301CEFEA.5.9.A09.1.454.light.4.raw

SEQ ID NO: 575043 - DNA, 499 bp, Homo sapiens; identical to SEQ ID NO: 562346
  misc_feature: HIJSMM301CX6X9.40.81.H04.1.454.light.4.raw

SEQ ID NO: 575044 - DNA, 472 bp, Homo sapiens; identical to SEQ ID NO: 536302
  misc_feature: HIJSMM301CZUXH.18.76.G10.1.454.light.4.raw

SEQ ID NO: 575045 - DNA, 505 bp, Homo sapiens
  misc_feature: HIJSMM301ESWYH.9.71.G05.1.454.light.4.raw
tgatacgtctcacgaccggtgctcgatttagtgtcgtcgcaagagagagggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccccg

SEQ ID NO: 575046 - DNA, 504 bp, Homo sapiens; identical to SEQ ID NO: 538940
  misc_feature: HIJSMM301DREMC.2.35.D02.1.454.light.4.raw

SEQ ID NO: 575047 - DNA, 486 bp, Homo sapiens
  misc_feature: HIJSMM301EWHHR.43.4.A04.1.454.light.4.raw
tgtgagtagtcacgaccggtgctcgatttagagtagtgatcaggggaagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagaggagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcggccaagggaccaaggtggacatcaaacgaactgtggctgcacc

SEQ ID NO: 575048 - DNA, 496 bp, Homo sapiens
  misc_feature: HIJSMM301EWDHW.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggaggatcagacgaactgtggctgcaccatctgtcttcatcttcccg

SEQ ID NO: 575049 - DNA, 512 bp, Homo sapiens
  misc_feature: HIJSMM301BNV12.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttcttcccccggacgtcgtccgaacggaccgaacgaggaagtacaagagaacagtggctcgcgccaactctcgttcttctactcttcccgt

SEQ ID NO: 575050 - DNA, 482 bp, Homo sapiens; identical to SEQ ID NO: 535216
  misc_feature: HIJSMM301BWF1Q.17.26.C04.1.454.light.4.raw

SEQ ID NO: 575051 - DNA, 489 bp, Homo sapiens; identical to SEQ ID NO: 543840
  misc_feature: HIJSMM301CEDKW.12.88.H11.1.454.light.4.raw

SEQ ID NO: 575052 - DNA, 501 bp, Homo sapiens
  misc_feature: HIJSMM301BGCTV.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggaggaccaagctgaccgtcctaggtcagcccaaggctgccccctcggtcacttcc

SEQ ID NO: 575053 - DNA, 481 bp, Homo sapiens
  misc_feature: HIJSMM301E10SJ.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctcgacgttcgccgaggacaaggtgactcaaacgaa

SEQ ID NO: 575054 - DNA, 464 bp, Homo sapiens; identical to SEQ ID NO: 536640
  misc_feature: HIJSMM301EKU72.26.78.H01.1.454.light.4.raw

SEQ ID NO: 575055 - DNA, 490 bp, Homo sapiens; identical to SEQ ID NO: 535234
  misc_feature: HIJSMM301AQH0U.17.21.B10.1.454.light.4.raw

SEQ ID NO: 575056 - DNA, 511 bp, Homo sapiens; identical to SEQ ID NO: 548214
  misc_feature: HIJSMM301AGCQO.19.59.F04.1.454.light.4.raw

SEQ ID NO: 575057 - DNA, 508 bp, Homo sapiens
  misc_feature: HIJSMM301ES8DC.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccaaggaccgaaggtaggaaatacaaacgaactagtggcgtgcaccat

SEQ ID NO: 575058 - DNA, 441 bp, Homo sapiens; identical to SEQ ID NO: 534971
  misc_feature: HIJSMM301BP3SA.11.3.A03.1.454.light.4.raw

SEQ ID NO: 575059 - DNA, 505 bp, Homo sapiens
  misc_feature: HIJSMM301DZTWE.51.41.D08.1.454.light.4.raw
cgatcgtatacacgaccggtgctcgatttagtcacgcgagaaagggaaagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaccttatgatgtacactggtaccaacaacttccaggagcagcccccaaactcctcatctttggtaacaacaatcggccctcaggggtccctgaccgattctctggctccaggtctggcacctcagcctccctggccatcactgggctccaggctgaggatgagggtgattattactgccagtcctatgacagcggcctcagttatttggtggtgttcgggcggagggaccaaggtgaccgtcctaagtcagaccccg

SEQ ID NO: 575060 - DNA, 485 bp, Homo sapiens
  misc_feature: HIJSMM301DTKH1.48.40.D07.1.454.light.4.raw
agtatacatacacgaccggtgctcgatttagtgatagagcgtaacaacagagggggatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggccaagggaccaacggtggagagtcaaacg

SEQ ID NO: 575061 - DNA, 444 bp, Homo sapiens; identical to SEQ ID NO: 537971
  misc_feature: HIJSMM301DM9VN.2.76.G10.1.454.light.4.raw

SEQ ID NO: 575062 - DNA, 512 bp, Homo sapiens; identical to SEQ ID NO: 556539
  misc_feature: HIJSMM301AO7UP.5.58.F03.1.454.light.4.raw

SEQ ID NO: 575063 - DNA, 501 bp, Homo sapiens; identical to SEQ ID NO: 537690
  misc_feature: HIJSMM301A0V6M.41.14.B03.1.454.light.4.raw

SEQ ID NO: 575064 - DNA, 502 bp, Homo sapiens
  misc_feature: HIJSMM301DEO88.2.76.G10.1.454.light.4.raw
  modified_base (463)..(463): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaaccgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggacctgggaccaaggtcaccgtctggt

SEQ ID NO: 575065 - DNA, 518 bp, Homo sapiens
  misc_feature: HIJSMM301A3R15.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctccccacttgctgcccacgggtccgaattctcagactgtggtgactcaggagccctcactgactgtgtccccacggagggacgagtcactctcacctgtgcttccaacactggagcagtcaccagtgcttactatccaaactggttccagcagaaacctggacaagcaccccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcatctgttcccgccct

SEQ ID NO: 575066 - DNA, 483 bp, Homo sapiens; identical to SEQ ID NO: 535675
  misc_feature: HIJSMM301ECL3J.41.35.D02.1.454.light.4.raw

SEQ ID NO: 575067 - DNA, 494 bp, Homo sapiens; identical to SEQ ID NO: 534994
  misc_feature: HIJSMM301B0S0A.27.78.H01.1.454.light.4.raw

SEQ ID NO: 575068 - DNA, 495 bp, Homo sapiens; identical to SEQ ID NO: 550692
  misc_feature: HIJSMM301DNSGW.3.33.C11.1.454.light.4.raw

SEQ ID NO: 575069 - DNA, 513 bp, Homo sapiens; identical to SEQ ID NO: 545469
  misc_feature: HIJSMM301ERLFE.8.23.C01.1.454.light.4.raw

SEQ ID NO: 575070 - DNA, 440 bp, Homo sapiens; identical to SEQ ID NO: 536696
  misc_feature: HIJSMM301DZFO9.11.3.A03.1.454.light.4.raw

SEQ ID NO: 575071 - DNA, 481 bp, Homo sapiens
  misc_feature: HIJSMM301CPI2K.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttggccaggggaccaaggtcgaaatgagacgaactgtggctgcacat

SEQ ID NO: 575072 - DNA, 487 bp, Homo sapiens; identical to SEQ ID NO: 537009
  misc_feature: HIJSMM301CWX4R.12.88.H11.1.454.light.4.raw

SEQ ID NO: 575073 - DNA, 486 bp, Homo sapiens
  misc_feature: HIJSMM301CNP52.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactcgtggctgcaccatctgtcttcta

SEQ ID NO: 575074 - DNA, 507 bp, Homo sapiens
  misc_feature: HIJSMM301DHOGO.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgt

SEQ ID NO: 575075 - DNA, 497 bp, Homo sapiens; identical to SEQ ID NO: 535740
  misc_feature: HIJSMM301BWFBB.3.71.G05.1.454.light.4.raw

SEQ ID NO: 575076 - DNA, 494 bp, Homo sapiens; identical to SEQ ID NO: 550254
  misc_feature: HIJSMM301CH8O0.48.1.A01.1.454.light.4.raw

SEQ ID NO: 575077 - DNA, 495 bp, Homo sapiens; identical to SEQ ID NO: 536931
  misc_feature: HIJSMM301AOTOR.10.33.C11.1.454.light.4.raw

SEQ ID NO: 575078 - DNA, 486 bp, Homo sapiens
  misc_feature: HIJSMM301BBKEN.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccacggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgccccccg

SEQ ID NO: 575079 - DNA, 489 bp, Homo sapiens
  misc_feature: HIJSMM301BQGXO.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccagggaccaagctggagatcaaacgaactgtgg

SEQ ID NO: 575080 - DNA, 505 bp, Homo sapiens
  misc_feature: HIJSMM301C7E7U.5.86.H09.1.454.light.4.raw
atcagacacgcacgaccggtgctcgatttagtgctatagacttggggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcta

SEQ ID NO: 575081 - DNA, 486 bp, Homo sapiens
  misc_feature: HIJSMM301CDA9N.15.1.A01.1.454.light.4.raw
  modified_base (468)..(468): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttccccnccctcctcgctacgtaga

SEQ ID NO: 575082 - DNA, 501 bp, Homo sapiens; identical to SEQ ID NO: 550407
  misc_feature: HIJSMM301A20XM.4.39.D06.1.454.light.4.raw

SEQ ID NO: 575083 - DNA, 514 bp, Homo sapiens
  misc_feature: HIJSMM301DSQ7L.40.42.D09.1.454.light.4.raw
tctagcgactcacgaccggtgctcgatttagacacatacgcagggaaagggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcg

SEQ ID NO: 575084 - DNA, 447 bp, Homo sapiens; identical to SEQ ID NO: 535201
  misc_feature: HIJSMM301EWMDI.18.9.A09.1.454.light.4.raw

SEQ ID NO: 575085 - DNA, 483 bp, Homo sapiens
  misc_feature: HIJSMM301B9VVO.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccagggacacgactggagattaaacgaactgtggctgcaccatct

SEQ ID NO: 575086 - DNA, 485 bp, Homo sapiens; identical to SEQ ID NO: 545289
  misc_feature: HIJSMM301CCXEX.19.71.G05.1.454.light.4.raw

SEQ ID NO: 575087 - DNA, 517 bp, Homo sapiens; identical to SEQ ID NO: 539798
  misc_feature: HIJSMM301AX7FI.14.70.G04.1.454.light.4.raw

SEQ ID NO: 575088 - DNA, 447 bp, Homo sapiens; identical to SEQ ID NO: 535201
  misc_feature: HIJSMM301A68TE.18.9.A09.1.454.light.4.raw

SEQ ID NO: 575089 - DNA, 496 bp, Homo sapiens; identical to SEQ ID NO: 537225
  misc_feature: HIJSMM301EX3S7.11.59.F04.1.454.light.4.raw

SEQ ID NO: 575090 - DNA, 520 bp, Homo sapiens
  misc_feature: HIJSMM301C3VGJ.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctcgtcccacct

SEQ ID NO: 575091 - DNA, 500 bp, Homo sapiens
  misc_feature: HIJSMM301ED6SQ.3.33.C11.1.454.light.4.raw
agacgcactccacgaccggtgctcgatttagagtgagctcgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatacaaggagcaccactctcgtggtatttggtggagggaccaaggctgaccgtcctaggtcagcccaaggctcg

SEQ ID NO: 575092 - DNA, 519 bp, Homo sapiens
  misc_feature: HIJSMM301BRPCU.12.71.G05.1.454.light.4.raw
atacgacgtacacgaccggtgctcgatttagtgtcgtcgcaagagagaggaggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgtttcggcggcgggaccaaagtgaccgtcctaagtcagcccaaggctgccccctcggtcactctgttcccta

SEQ ID NO: 575093 - DNA, 488 bp, Homo sapiens; identical to SEQ ID NO: 535568
  misc_feature: HIJSMM301C5GFW.21.4.A04.1.454.light.4.raw

SEQ ID NO: 575094 - DNA, 494 bp, Homo sapiens
  misc_feature: HIJSMM301EINEQ.48.30.C08.1.454.light.4.raw
agtatacatacacgaccggtgctcgatttagtctgacgtcaaagggaaggggggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccaggtttccaggctcctcatccatggtgcatccaccagggccactggtatctcagccaggttcagtgccagtgggcctgggacagagttcactctcaccatcaccagcctgcagtctgaagattttgctattttattactgtcagcactataataactggccacgtggacgttcggccaagggaccaaggtggaaatcaaacgaactgtggctgcaccatctgtcttcatcttcccgccat

SEQ ID NO: 575095 - DNA, 494 bp, Homo sapiens; identical to SEQ ID NO: 535629
  misc_feature: HIJSMM301EBL7H.4.27.C05.1.454.light.4.raw

SEQ ID NO: 575096 - DNA, 505 bp, Homo sapiens; identical to SEQ ID NO: 546621
  misc_feature: HIJSMM301BSIS7.15.86.H09.1.454.light.4.raw

SEQ ID NO: 575097 - DNA, 501 bp, Homo sapiens
  misc_feature: HIJSMM301D9E2O.9.53.E09.1.454.light.4.raw
tgatacgtctcacgaccggtgctcgatttagagagagtgtgttgggtttggggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccc

SEQ ID NO: 575098 - DNA, 493 bp, Homo sapiens; identical to SEQ ID NO: 538503
  misc_feature: HIJSMM301CDNT6.9.1.A01.1.454.light.4.raw

SEQ ID NO: 575099 - DNA, 513 bp, Homo sapiens; identical to SEQ ID NO: 561267
  misc_feature: HIJSMM301CSJNW.22.36.D03.1.454.light.4.raw

SEQ ID NO: 575100 - DNA, 497 bp, Homo sapiens; identical to SEQ ID NO: 536371
  misc_feature: HIJSMM301ADGS6.16.78.H01.1.454.light.4.raw

SEQ ID NO: 575101 - DNA, 521 bp, Homo sapiens; identical to SEQ ID NO: 539470
  misc_feature: HIJSMM301AYJ3P.27.23.C01.1.454.light.4.raw

SEQ ID NO: 575102 - DNA, 519 bp, Homo sapiens
  misc_feature: HIJSMM301CYKPC.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgacgtcctaggtcagcccaaggctgccccctcggtcactctgttccaccct

SEQ ID NO: 575103 - DNA, 366 bp, Homo sapiens
  misc_feature: HIJSMM301DQB7Y.41.34.D01.1.454.light.4.raw
tctatactatcacgaccggtgctcgatttagatcgtctgtgttgggtttggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacga

SEQ ID NO: 575104 - DNA, 503 bp, Homo sapiens
  misc_feature: HIJSMM301CJ9KG.18.11.A11.1.454.light.4.raw
tacgagtatgcacgaccggtgctcgatttagctacgactgcagggggagctacaacaggcaggcaggggcagcaagatggtgttgcggacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttca

SEQ ID NO: 575105 - DNA, 485 bp, Homo sapiens; identical to SEQ ID NO: 539041
  misc_feature: HIJSMM301BCBUD.46.26.C04.1.454.light.4.raw

SEQ ID NO: 575106 - DNA, 485 bp, Homo sapiens
  misc_feature: HIJSMM301DHKOS.48.10.A10.1.454.light.4.raw
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaaggaccgaggtggaaagtacaaacgaactagtggctgcaccatctgtcttcatt

SEQ ID NO: 575107 - DNA, 444 bp, Homo sapiens; identical to SEQ ID NO: 535027
  misc_feature: HIJSMM301E1ED6.8.73.G07.1.454.light.4.raw

SEQ ID NO: 575108 - DNA, 483 bp, Homo sapiens; identical to SEQ ID NO: 571581
  misc_feature: HIJSMM301AUKKF.40.8.A08.1.454.light.4.raw

SEQ ID NO: 575109 - DNA, 495 bp, Homo sapiens
  misc_feature: HIJSMM301BGMDD.51.57.F02.1.454.light.4.raw
cgatcgtatacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 575110 - DNA, 474 bp, Homo sapiens; identical to SEQ ID NO: 537034
  misc_feature: HIJSMM301BW7S1.5.15.B04.1.454.light.4.raw

SEQ ID NO: 575111 - DNA, 504 bp, Homo sapiens; identical to SEQ ID NO: 542411
  misc_feature: HIJSMM301DW3UA.9.53.E09.1.454.light.4.raw

SEQ ID NO: 575112 - DNA, 509 bp, Homo sapiens
  misc_feature: HIJSMM301B5Z25.47.85.H08.1.454.light.4.raw
agctcacgtacacgaccggtgctcgatttagtatcactcagtcgcgggggggtcgtcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacatggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactcttcg

SEQ ID NO: 575113 - DNA, 513 bp, Homo sapiens
  misc_feature: HIJSMM301C9A2K.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaacccccactgtcactctgttccccgccct

SEQ ID NO: 575114 - DNA, 494 bp, Homo sapiens
  misc_feature: HIJSMM301AMK5E.5.11.A11.1.454.light.4.raw
atcagacacgcacgaccggtgctcgatttagctacgactgcaggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttcttgcatgcaaggtacacactggccgtacacttttggccaggggaccaagctggagatcaaacgaactgtggctgcacca

SEQ ID NO: 575115 - DNA, 485 bp, Homo sapiens
  misc_feature: HIJSMM301DBVG9.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtccaccaaatttcagtggcagtggatctgggacagatttcactctcagcattaataatctgcaacctgaggattttgcaacttactactgtcaacagagttacaggcccccctatacttttggcctaggggccaagctggagatcacaggaactgtggctgcacc

SEQ ID NO: 575116 - DNA, 507 bp, Homo sapiens
  misc_feature: HIJSMM301C9SRI.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaggctcgtccccccg

SEQ ID NO: 575117 - DNA, 377 bp, Homo sapiens; identical to SEQ ID NO: 536071
  misc_feature: HIJSMM301CLSCK.40.9.A09.1.454.light.4.raw

SEQ ID NO: 575118 - DNA, 515 bp, Homo sapiens
  misc_feature: HIJSMM301EYQEX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcggtccgaagggaccgaaaggtaggaaaagtcgaaacgaaacctagtggcgtgcaccactctgtcttctatcttccccg

SEQ ID NO: 575119 - DNA, 490 bp, Homo sapiens
  misc_feature: HIJSMM301CUN34.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcacctttcggcggagggaccaaggcggagatcagacgaactgtggctgcaccatctgtcttca

SEQ ID NO: 575120 - DNA, 489 bp, Homo sapiens
  misc_feature: HIJSMM301BQ8CX.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccgagggaccgacggtggagtgtcgaagcgaactacgtgcgtgcgaccact

SEQ ID NO: 575121 - DNA, 505 bp, Homo sapiens; identical to SEQ ID NO: 535987
  misc_feature: HIJSMM301E3ORZ.18.37.D04.1.454.light.4.raw

SEQ ID NO: 575122 - DNA, 521 bp, Homo sapiens; identical to SEQ ID NO: 538715
  misc_feature: HIJSMM301BKT22.27.23.C01.1.454.light.4.raw

SEQ ID NO: 575123 - DNA, 479 bp, Homo sapiens; identical to SEQ ID NO: 550648
  misc_feature: HIJSMM301AJ8RF.4.33.C11.1.454.light.4.raw

SEQ ID NO: 575124 - DNA, 349 bp, Homo sapiens; identical to SEQ ID NO: 560985
  misc_feature: HIJSMM301DO7MS.19.86.H09.1.454.light.4.raw

SEQ ID NO: 575125 - DNA, 497 bp, Homo sapiens; identical to SEQ ID NO: 536371
  misc_feature: HIJSMM301DLV6D.16.78.H01.1.454.light.4.raw

SEQ ID NO: 575126 - DNA, 489 bp, Homo sapiens
  misc_feature: HIJSMM301CRDWW.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgctaatttattactgtcagcaatataatacctggcctccgctcactttcggcggagggaccaaggttgagatacaaacgaactgtggctgcacc

SEQ ID NO: 575127 - DNA, 503 bp, Homo sapiens; identical to SEQ ID NO: 537189
  misc_feature: HIJSMM301ADZE7.19.85.H08.1.454.light.4.raw

SEQ ID NO: 575128 - DNA, 488 bp, Homo sapiens; identical to SEQ ID NO: 536861
  misc_feature: HIJSMM301DTABN.12.88.H11.1.454.light.4.raw

SEQ ID NO: 575129 - DNA, 486 bp, Homo sapiens
  misc_feature: HIJSMM301B5NDD.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaaggacacgactggagattaaacgaactgtggctgcaccatctgtt

SEQ ID NO: 575130 - DNA, 486 bp, Homo sapiens; identical to SEQ ID NO: 536555
  misc_feature: HIJSMM301AYCNI.26.23.C01.1.454.light.4.raw

SEQ ID NO: 575131 - DNA, 492 bp, Homo sapiens; identical to SEQ ID NO: 535126
  misc_feature: HIJSMM301BXMCT.18.11.A11.1.454.light.4.raw

SEQ ID NO: 575132 - DNA, 506 bp, Homo sapiens
  misc_feature: HIJSMM301BYIP0.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactagtggctcgcaccatctgtcttcatcttcccgcca

SEQ ID NO: 575133 - DNA, 433 bp, Homo sapiens; identical to SEQ ID NO: 535093
  misc_feature: HIJSMM301DXA3O.18.5.A05.1.454.light.4.raw

SEQ ID NO: 575134 - DNA, 486 bp, Homo sapiens; identical to SEQ ID NO: 535290
  misc_feature: HIJSMM301AKA6V.3.12.B01.1.454.light.4.raw

SEQ ID NO: 575135 - DNA, 519 bp, Homo sapiens; identical to SEQ ID NO: 575102
  misc_feature: HIJSMM301BLGEA.27.23.C01.1.454.light.4.raw

SEQ ID NO: 575136 - DNA, 505 bp, Homo sapiens
  misc_feature: HIJSMM301BUVHM.3.79.H02.1.454.light.4.raw
  modified_base (434)..(434): a, c, t, g, unknown or other
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggngcaccactctcgtggtattggtggaggaccaagctgaccgtcctaggtcagcccaaggctcgccccctggt

SEQ ID NO: 575137 - DNA, 519 bp, Homo sapiens; identical to SEQ ID NO: 559680
  misc_feature: HIJSMM301D7CLM.7.86.H09.1.454.light.4.raw

SEQ ID NO: 575138 - DNA, 509 bp, Homo sapiens
  misc_feature: HIJSMM301B2BQ8.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggatcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattagagatcaaacgaactgtggctgcaccatctgtcttcatcttcccg

SEQ ID NO: 575139 - DNA, 481 bp, Homo sapiens; identical to SEQ ID NO: 535993
  misc_feature: HIJSMM301ALG7Y.21.25.C03.1.454.light.4.raw

SEQ ID NO: 575140 - DNA, 508 bp, Homo sapiens
  misc_feature: HIJSMM301DYA91.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcgttgctctcctatagtggtgttcgggtgttcggcggagggaccaagctgaccgtcctaggtcagcccaaggctgccccctcggtcactctgttcccaccctcctcgctacgtaga

SEQ ID NO: 575141 - DNA, 488 bp, Homo sapiens
  misc_feature: HIJSMM301BCGGU.41.33.C11.1.454.light.4.raw
tctatactatcacgaccggtgctcgatttagagtgagctcgttgggtttgggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctccccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaagtggatttcaaacgaactgtggctgcacc

SEQ ID NO: 575142 - DNA, 485 bp, Homo sapiens; identical to SEQ ID NO: 535880
  misc_feature: HIJSMM301D8ASH.7.75.G09.1.454.light.4.raw

SEQ ID NO: 575143 - DNA, 485 bp, Homo sapiens; identical to SEQ ID NO: 535985
  misc_feature: HIJSMM301EU629.15.1.A01.1.454.light.4.raw

SEQ ID NO: 575144 - DNA, 484 bp, Homo sapiens
  misc_feature: HIJSMM301DCSWI.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccgggtccctgacaggttcagtggcagtggatcaggcacagattttacactgaaaatcagcagagtggaggctgaggatgttgggctctattattgcatgcaagctctacaagtcccgctcactttcggcgagggaccaaggtggagatcaaacgtaac

SEQ ID NO: 575145 - DNA, 466 bp, Homo sapiens
  misc_feature: HIJSMM301BAT0F.48.23.C01.1.454.light.4.raw
agtatacatacacgaccggtgctcgatttagtacacgtgattagggattgggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtgctgcaccatctgtcttcatcttcccgccatctgatatgtatact

SEQ ID NO: 575146 - DNA, 507 bp, Homo sapiens
  misc_feature: HIJSMM301D8QMG.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgtcccaccct

SEQ ID NO: 575147 - DNA, 507 bp, Homo sapiens
  misc_feature: HIJSMM301BOUTX.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgtttatatagccccaggaacaaggactacctggcttggttccagcacaaaccagggcagcctccaaagctgctcatttacttgggatctacccgggaatccggggtccctgaccgattccgtggcaggcgggtctgggacagacttcactctcaccatcagtagcctgcagcctgaagatgtggcaacttattactgtcaacatttcgttatactccgccgacgttcggccggggaccgaccgtcgaagtacaacgaactgtggctgcaccatctgtctt

SEQ ID NO: 575148 - DNA, 494 bp, Homo sapiens; identical to SEQ ID NO: 534992
  misc_feature: HIJSMM301ETN8N.9.1.A01.1.454.light.4.raw

SEQ ID NO: 575149 - DNA, 472 bp, Homo sapiens; identical to SEQ ID NO: 536302
  misc_feature: HIJSMM301DBOTP.18.76.G10.1.454.light.4.raw

SEQ ID NO: 575150 - DNA, 521 bp, Homo sapiens; identical to SEQ ID NO: 536990
  misc_feature: HIJSMM301BYZS0.27.23.C01.1.454.light.4.raw
  modified_base (517)..(517): a, c, t, g, unknown or other

SEQ ID NO: 575151 - DNA, 476 bp, Homo sapiens; identical to SEQ ID NO: 566196
  misc_feature: HIJSMM301DTLLX.48.85.H08.1.454.light.4.raw

SEQ ID NO: 575152 - DNA, 489 bp, Homo sapiens; identical to SEQ ID NO: 546040
  misc_feature: HIJSMM301AWOIX.11.12.B01.1.454.light.4.raw

SEQ ID NO: 575153 - DNA, 489 bp, Homo sapiens; identical to SEQ ID NO: 543248
  misc_feature: HIJSMM301D65AJ.14.55.E11.1.454.light.4.raw

SEQ ID NO: 575154 - DNA, 518 bp, Homo sapiens; identical to SEQ ID NO: 555949
  misc_feature: HIJSMM301AH28W.41.25.C03.1.454.light.4.raw

SEQ ID NO: 575155 - DNA, 481 bp, Homo sapiens; identical to SEQ ID NO: 539712
  misc_feature: HIJSMM301B5KBX.51.60.F05.1.454.light.4.raw

SEQ ID NO: 575156 - DNA, 496 bp, Homo sapiens
  misc_feature: HIJSMM301CQ2FR.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccagggggacccaggtggagatcagacgaactgtggctgcaccatctgtcttcatcttcccg

SEQ ID NO: 575157 - DNA, 493 bp, Homo sapiens; identical to SEQ ID NO: 535084
  misc_feature: HIJSMM301CFK0J.47.64.F09.1.454.light.4.raw

SEQ ID NO: 575158 - DNA, 486 bp, Homo sapiens; identical to SEQ ID NO: 535043
  misc_feature: HIJSMM301CGZ35.46.35.D02.1.454.light.4.raw

SEQ ID NO: 575159 - DNA, 490 bp, Homo sapiens; identical to SEQ ID NO: 570189
  misc_feature: HIJSMM301BDMPH.8.4.A04.1.454.light.4.raw

SEQ ID NO: 575160 - DNA, 494 bp, Homo sapiens; identical to SEQ ID NO: 534994
  misc_feature: HIJSMM301EGQN1.27.78.H01.1.454.light.4.raw

SEQ ID NO: 575161 - DNA, 505 bp, Homo sapiens
  misc_feature: HIJSMM301B783Q.41.87.H10.1.454.light.4.raw
tctatactatcacgaccggtgctcgatttagcagtactgcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgatttattactgcagctcatatacaagcagcagcactctcgtggtattcggcggagggaccaagctgaccgtcctaggtcagcccaaggctcgcccccg

SEQ ID NO: 575162 - DNA, 444 bp, Homo sapiens; identical to SEQ ID NO: 538511
  misc_feature: HIJSMM301EJI87.5.9.A09.1.454.light.4.raw
  modified_base (426)..(426): a, c, t, g, unknown or other

SEQ ID NO: 575163 - DNA, 481 bp, Homo sapiens
  misc_feature: HIJSMM301ERN4N.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggtagggaccaagctgaccgtcctaagtcagaccccg

SEQ ID NO: 575164 - DNA, 470 bp, Homo sapiens
  misc_feature: HIJSMM301BEGVF.43.75.G09.1.454.light.4.raw
tgtgagtagtcacgaccggtgctcgatttagtatagacatcaggggaggaatcagacccagtcaggacacagcatggacatgagagtcctcgctcagctcctggggctcctgctgctctgtttcccaggtgccagatgtgacatccagatgacccagtctccatcctcactgtctgcatctgtgggagacagggtcaccttcacttgtcgggcgagtcagcgcattagcaattatttagcctggtttcagcagaaaccagggaaagcccctcagtccctgatctatgctgcattcaatttgcatagtggcgtcccatcaagattcagcgccagtggatctgggatagctttcactctcaccatcgccagcctgcagcccgaagtattttgctaacttattactgccaacagtatgatgattacccgtactacttttggccaggggaccaagcgtggagatcaatcgaact

SEQ ID NO: 575165 - DNA, 507 bp, Homo sapiens
  misc_feature: HIJSMM301AREW2.48.73.G07.1.454.light.4.raw
agtatacatacacgaccggtgctcgatttagctctacgctcagggcacgaccggtgctcgatttagtatctgatagttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactgggcgtcttcccgggagtccgggtccctgaccgattcagtgccagcgggtctgggacagacttcactctcaccatcagcggcctgcaggctgaagatgtggcagtttattactgtcagcactgttttggcggttctccgtactttcggcggagggaccgaaggt

SEQ ID NO: 575166 - DNA, 517 bp, Homo sapiens; identical to SEQ ID NO: 555770
  misc_feature: HIJSMM301AMCC3.27.23.C01.1.454.light.4.raw

SEQ ID NO: 575167 - DNA, 486 bp, Homo sapiens
  misc_feature: HIJSMM301EKE3E.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcattctgttcccaccctcctccgctacgtaga

SEQ ID NO: 575168 - DNA, 497 bp, Homo sapiens; identical to SEQ ID NO: 545672
  misc_feature: HIJSMM301CIPWW.2.49.E05.1.454.light.4.raw

SEQ ID NO: 575169 - DNA, 491 bp, Homo sapiens
  misc_feature: HIJSMM301D584G.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggagacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaaacg

SEQ ID NO: 575170 - DNA, 499 bp, Homo sapiens; identical to SEQ ID NO: 544831
  misc_feature: HIJSMM301DXDVW.41.53.E09.1.454.light.4.raw

SEQ ID NO: 575171 - DNA, 520 bp, Homo sapiens; identical to SEQ ID NO: 551527
  misc_feature: HIJSMM301DOBQU.7.86.H09.1.454.light.4.raw

SEQ ID NO: 575172 - DNA, 515 bp, Homo sapiens; identical to SEQ ID NO: 538805
  misc_feature: HIJSMM301AFJ4L.14.19.B08.1.454.light.4.raw

SEQ ID NO: 575173 - DNA, 504 bp, Homo sapiens; identical to SEQ ID NO: 555616
  misc_feature: HIJSMM301EB07E.5.86.H09.1.454.light.4.raw

SEQ ID NO: 575174 - DNA, 491 bp, Homo sapiens; identical to SEQ ID NO: 564347
  misc_feature: HIJSMM301D7O8L.22.65.F10.1.454.light.4.raw

SEQ ID NO: 575175 - DNA, 465 bp, Homo sapiens; identical to SEQ ID NO: 559472
  misc_feature: HIJSMM301D7QMR.18.59.F04.1.454.light.4.raw

SEQ ID NO: 575176 - DNA, 486 bp, Homo sapiens
  misc_feature: HIJSMM301CIH97.12.1.A01.1.454.light.4.raw
atacgacgtacacgaccggtgctcgatttagacgtctcatcaggggagtcgtcagtcaggacacagcatggacatgagggtccccgctcagctcctggggctcctgctactctggctccgaggtgccagatgtggacatccggatgacccagtctccatcctccctgtctgcatctgtagcagacagagtcaccatcacttgccgggcaagtcaagaccatcagcagctatttaaattggtatcagcagaaaccagggaaagcccctaaggtcctgatctatgctgcatccagtttgcaaagtggggtcccatcaaggttcagtggcagtgggtctggggacagatttcactctcaccatcagcagtctgtcaacctgaagattctgcaacttattactgtcaacagagtaacagttaccctcccactttcggcggagggaccaaggtcggagatcaaacgaactcgtggctgcaccatctgtctt

SEQ ID NO: 575177 - DNA, 514 bp, Homo sapiens
  misc_feature: HIJSMM301CSEKR.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcctcctcc

SEQ ID NO: 575178 - DNA, 512 bp, Homo sapiens; identical to SEQ ID NO: 553087
  misc_feature: HIJSMM301DGLUG.43.23.C01.1.454.light.4.raw

SEQ ID NO: 575179 - DNA, 502 bp, Homo sapiens
  misc_feature: HIJSMM301CKPI6.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcacttcggccaagggacacgactggagattaaacg

SEQ ID NO: 575180 - DNA, 497 bp, Homo sapiens; identical to SEQ ID NO: 536376
  misc_feature: HIJSMM301ECAG0.22.9.A09.1.454.light.4.raw

SEQ ID NO: 575181 - DNA, 502 bp, Homo sapiens
  misc_feature: HIJSMM301AFIQG.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcaggcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 575182 - DNA, 506 bp, Homo sapiens
  misc_feature: HIJSMM301EG02C.18.11.A11.1.454.light.4.raw
tacgagtatgcacgaccggtgctcgatttagctacgactgcagggggagctacaacaggcaggcaggggcagcaagatggtgttgtagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccaccaccaacctgcaggctgaagatgtggcagtttattactgtcagcaatactatagtcctcctctcacgttcggcggagggaccaaggtggagatcaaacgaactgtggctgcaccatcctgtcttcatt

SEQ ID NO: 575183 - DNA, 505 bp, Homo sapiens
  misc_feature: HIJSMM301EYB74.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggcagcccaaggcccaacccactgtcta

SEQ ID NO: 575184 - DNA, 499 bp, Homo sapiens
  misc_feature: HIJSMM301B394P.40.71.G05.1.454.light.4.raw
tctagcgactcacgaccggtgctcgatttagtgtcgtcgcaagagagagggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagccgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtctaggt

SEQ ID NO: 575185 - DNA, 488 bp, Homo sapiens
  misc_feature: HIJSMM301ENSFN.15.1.A01.1.454.light.4.raw
  modified_base (364)..(364): a, c, t, g, unknown or other
tctacgtagccacgaccggtgctcgatttagacgtctcatctagggccgtgggctctgctgctcctcactctcctcactcaggaacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattnttactgctgctcatatgaaggttataacactatactattcggcggagggaccaagctgaccgtcctgcgtcagcccaaggctgccccctcggtcactctgttcccgccctcctcgctacgtaga

SEQ ID NO: 575186 - DNA, 483 bp, Homo sapiens; identical to SEQ ID NO: 536691
  misc_feature: HIJSMM301BS376.17.26.C04.1.454.light.4.raw

SEQ ID NO: 575187 - DNA, 515 bp, Homo sapiens
  misc_feature: HIJSMM301CLCXH.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtgggcaggtcagccaaggccaacccgactgtcactctcg

SEQ ID NO: 575188 - DNA, 497 bp, Homo sapiens
  misc_feature: HIJSMM301BIJIK.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctcttggctccagactgaggacgaggctgattattactgcagctcacatacaagcggcagcggttgggtgttcggcgggggacacactgaccgtcctaggtcagccaaggctgcccctcggtcactctcgttcccaccctcctccacctactatg

SEQ ID NO: 575189 - DNA, 487 bp, Homo sapiens
  misc_feature: HIJSMM301EJO4J.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttatactgtcagcaatataatacctggcctccgctcactttcggcggagggaccaaggttgagatcaaacgaactgtggctgcacca

SEQ ID NO: 575190 - DNA, 486 bp, Homo sapiens; identical to SEQ ID NO: 537428
  misc_feature: HIJSMM301ETFUC.47.62.F07.1.454.light.4.raw

SEQ ID NO: 575191 - DNA, 490 bp, Homo sapiens; identical to SEQ ID NO: 535234
  misc_feature: HIJSMM301CFUT9.17.21.B10.1.454.light.4.raw

SEQ ID NO: 575192 - DNA, 503 bp, Homo sapiens; identical to SEQ ID NO: 538884
  misc_feature: HIJSMM301EZKR3.27.78.H01.1.454.light.4.raw

SEQ ID NO: 575193 - DNA, 494 bp, Homo sapiens
  misc_feature: HIJSMM301DRX2L.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagtcgtgagttctggcctccgctcactttcggcggagggaccagggtggagatcaaacgaactgtggctgcaccatctgtcttcatt

SEQ ID NO: 575194 - DNA, 487 bp, Homo sapiens
  misc_feature: HIJSMM301BUVSC.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagaatgtggcagtttattattgtcaacaatattattatacttcgtggacgttcggccaagggaccaaggtggatatcagacgaa

SEQ ID NO: 575195 - DNA, 506 bp, Homo sapiens; identical to SEQ ID NO: 534969
  misc_feature: HIJSMM301EQWRT.18.37.D04.1.454.light.4.raw

SEQ ID NO: 575196 - DNA, 483 bp, Homo sapiens
  misc_feature: HIJSMM301BJI8H.41.34.D01.1.454.light.4.raw
tctatactatcacgaccggtgctcgatttagatcgtctgtgttgggtttggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcaccta

SEQ ID NO: 575197 - DNA, 453 bp, Homo sapiens
  misc_feature: HIJSMM301BJX1I.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctggtcactctgttcccgccctcctccacgagagta

SEQ ID NO: 575198 - DNA, 513 bp, Homo sapiens; identical to SEQ ID NO: 535244
  misc_feature: HIJSMM301EYY7K.17.33.C11.1.454.light.4.raw

SEQ ID NO: 575199 - DNA, 501 bp, Homo sapiens; identical to SEQ ID NO: 535746
  misc_feature: HIJSMM301EXPRE.18.11.A11.1.454.light.4.raw

SEQ ID NO: 575200 - DNA, 492 bp, Homo sapiens; identical to SEQ ID NO: 550582
  misc_feature: HIJSMM301EEN0I.10.72.G06.1.454.light.4.raw

SEQ ID NO: 575201 - DNA, 515 bp, Homo sapiens
  misc_feature: HIJSMM301ESR49.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagtctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccgactttcggtcccgtcgggaccgaaggtggagatcaaacgaactagtggctgcaccatctgtcttcta

SEQ ID NO: 575202 - DNA, 496 bp, Homo sapiens; identical to SEQ ID NO: 535109
  misc_feature: HIJSMM301DXV6U.16.78.H01.1.454.light.4.raw

SEQ ID NO: 575203 - DNA, 472 bp, Homo sapiens; identical to SEQ ID NO: 536302
  misc_feature: HIJSMM301A7KB1.18.76.G10.1.454.light.4.raw

SEQ ID NO: 575204 - DNA, 499 bp, Homo sapiens
  misc_feature: HIJSMM301AGQ1J.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggct

SEQ ID NO: 575205 - DNA, 484 bp, Homo sapiens
  misc_feature: HIJSMM301AIS96.3.59.F04.1.454.light.4.raw
agacgcactccacgaccggtgctcgatttagtacacacacttagggattggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacaccgacttggattggtttcaacagaggccaggccaatctccaaggcgcctaatttataaggtttctaagcgcgactctggggtcccagacagattcagcggcagtgggtcaggcactgacttcacactggaaatcagcagggtggaggctgaggatgttgcggtttattactgcatgcaatatacacataggcctcacacctttggccaggggaccaagctggagatcaaacgaa

SEQ ID NO: 575206 - DNA, 491 bp, Homo sapiens; identical to SEQ ID NO: 544714
  misc_feature: HIJSMM301CD7VP.18.11.A11.1.454.light.4.raw

SEQ ID NO: 575207 - DNA, 494 bp, Homo sapiens; identical to SEQ ID NO: 534992
  misc_feature: HIJSMM301BTZXV.9.1.A01.1.454.light.4.raw

SEQ ID NO: 575208 - DNA, 493 bp, Homo sapiens; identical to SEQ ID NO: 543554
  misc_feature: HIJSMM301EO9EN.10.77.G11.1.454.light.4.raw

SEQ ID NO: 575209 - DNA, 525 bp, Homo sapiens
  misc_feature: HIJSMM301CTHJL.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctccggtcactctcgttcccaccct

SEQ ID NO: 575210 - DNA, 444 bp, Homo sapiens; identical to SEQ ID NO: 535594
  misc_feature: HIJSMM301D0IFC.9.9.A09.1.454.light.4.raw

SEQ ID NO: 575211 - DNA, 483 bp, Homo sapiens; identical to SEQ ID NO: 535317
  misc_feature: HIJSMM301A6K6J.4.1.A01.1.454.light.4.raw

SEQ ID NO: 575212 - DNA, 441 bp, Homo sapiens; identical to SEQ ID NO: 534971
  misc_feature: HIJSMM301BJ1QT.11.3.A03.1.454.light.4.raw

SEQ ID NO: 575213 - DNA, 490 bp, Homo sapiens; identical to SEQ ID NO: 560474
  misc_feature: HIJSMM301BCD4O.14.55.E11.1.454.light.4.raw

SEQ ID NO: 575214 - DNA, 386 bp, Homo sapiens
  misc_feature: HIJSMM301DTS71.49.34.D01.1.454.light.4.raw
agtcgagagacacgaccggtgctcgatttagatcgtctgtgttgggtttggggtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagatttttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 575215 - DNA, 460 bp, Homo sapiens; identical to SEQ ID NO: 536053
  misc_feature: HIJSMM301AFQIK.22.28.C06.1.454.light.4.raw

SEQ ID NO: 575216 - DNA, 504 bp, Homo sapiens
  misc_feature: HIJSMM301EJWAW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaacgggaccaaggtaggaatacaaacgaactagtggctgcaccatctgtcttcatcttccccg

SEQ ID NO: 575217 - DNA, 494 bp, Homo sapiens; identical to SEQ ID NO: 534994
  misc_feature: HIJSMM301C641X.27.78.H01.1.454.light.4.raw

SEQ ID NO: 575218 - DNA, 384 bp, Homo sapiens; identical to SEQ ID NO: 555393
  misc_feature: HIJSMM301AVT59.48.87.H10.1.454.light.4.raw

SEQ ID NO: 575219 - DNA, 509 bp, Homo sapiens; identical to SEQ ID NO: 537131
  misc_feature: HIJSMM301BS7M6.17.33.C11.1.454.light.4.raw

SEQ ID NO: 575220 - DNA, 501 bp, Homo sapiens
  misc_feature: HIJSMM301DXKV2.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaacctcccgggccagcagtggtaacattgtgatattcgggcggagggaccgaaggtgaccgtcctacgtcagcccaaggctcgccccctcggtcactctcg

SEQ ID NO: 575221 - DNA, 507 bp, Homo sapiens
  misc_feature: HIJSMM301CD0DR.48.30.C08.1.454.light.4.raw
agtatacatacacgaccggtgctcgatttagtctgacgtcaaagggaaagggggaggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccgaaggtggaaatcaaacgaactgtggctgcacca

SEQ ID NO: 575222 - DNA, 486 bp, Homo sapiens; identical to SEQ ID NO: 535043
  misc_feature: HIJSMM301A2TRG.46.35.D02.1.454.light.4.raw

SEQ ID NO: 575223 - DNA, 502 bp, Homo sapiens
  misc_feature: HIJSMM301DB4QA.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggcacgactggagattaaacg

SEQ ID NO: 575224 - DNA, 447 bp, Homo sapiens; identical to SEQ ID NO: 535201
  misc_feature: HIJSMM301EL9GL.18.9.A09.1.454.light.4.raw

SEQ ID NO: 575225 - DNA, 514 bp, Homo sapiens
  misc_feature: HIJSMM301B2SMW.48.14.B03.1.454.light.4.raw
agtatacatacacgaccggtgctcgatttagtgtgagtagttccgcggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactgtggctgcaccatctgtcttcatcttcccg

SEQ ID NO: 575226 - DNA, 483 bp, Homo sapiens; identical to SEQ ID NO: 542200
  misc_feature: HIJSMM301ERG5R.7.75.G09.1.454.light.4.raw

SEQ ID NO: 575227 - DNA, 488 bp, Homo sapiens
  misc_feature: HIJSMM301ALT7K.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccacgttcggcggagggaccacagtcgagatcaaacgaactgtggccgcaccatctgt

SEQ ID NO: 575228 - DNA, 517 bp, Homo sapiens
  misc_feature: HIJSMM301AMIXX.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgtttccc

SEQ ID NO: 575229 - DNA, 488 bp, Homo sapiens; identical to SEQ ID NO: 537260
  misc_feature: HIJSMM301AGHK2.47.70.G04.1.454.light.4.raw

SEQ ID NO: 575230 - DNA, 494 bp, Homo sapiens; identical to SEQ ID NO: 552502
  misc_feature: HIJSMM301AXAJP.13.11.A11.1.454.light.4.raw

SEQ ID NO: 575231 - DNA, 513 bp, Homo sapiens
  misc_feature: HIJSMM301BN1WL.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtctaagtcagcccaaggctgccccctcggtcactctgttccccg

SEQ ID NO: 575232 - DNA, 506 bp, Homo sapiens; identical to SEQ ID NO: 541085
  misc_feature: HIJSMM301AHEIR.16.46.E02.1.454.light.4.raw

SEQ ID NO: 575233 - DNA, 493 bp, Homo sapiens; identical to SEQ ID NO: 536769
  misc_feature: HIJSMM301DF2QQ.19.83.H06.1.454.light.4.raw

SEQ ID NO: 575234 - DNA, 502 bp, Homo sapiens; identical to SEQ ID NO: 541971
  misc_feature: HIJSMM301CQRHI.4.39.D06.1.454.light.4.raw

SEQ ID NO: 575235 - DNA, 496 bp, Homo sapiens; identical to SEQ ID NO: 552284
  misc_feature: HIJSMM301BTL0W.40.23.C01.1.454.light.4.raw

SEQ ID NO: 575236 - DNA, 422 bp, Homo sapiens; identical to SEQ ID NO: 447881
  misc_feature: HIJSMM301CWG15.9.34.D01.1.454.light.4.raw

SEQ ID NO: 575237 - DNA, 491 bp, Homo sapiens; identical to SEQ ID NO: 536211
  misc_feature: HIJSMM301AJ7RD.16.53.E09.1.454.light.4.raw

SEQ ID NO: 575238 - DNA, 465 bp, Homo sapiens
  misc_feature: HIJSMM301EU4HJ.49.4.A04.1.454.light.4.raw
agtcgagagacacgaccggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtaatgatcgcctcccgctcactttcggcgggggaccgaaggtggagatcaagcgaactgtgg

SEQ ID NO: 575239 - DNA, 496 bp, Homo sapiens
  misc_feature: HIJSMM301EJX52.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcacccctcaccatcaatagcctggaagctgaagatgctgcaacttattactgtcatcagagtactactttacctcaagtgatcaccttcggccaagggacacgactggagattaaacgaactagtggctgcaccatctgtctt

SEQ ID NO: 575240 - DNA, 441 bp, Homo sapiens; identical to SEQ ID NO: 534971
  misc_feature: HIJSMM301BLJFB.11.3.A03.1.454.light.4.raw

SEQ ID NO: 575241 - DNA, 485 bp, Homo sapiens
  misc_feature: HIJSMM301CSX98.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctggagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 575242 - DNA, 514 bp, Homo sapiens; identical to SEQ ID NO: 550589
  misc_feature: HIJSMM301CUMJW.16.66.F11.1.454.light.4.raw

SEQ ID NO: 575243 - DNA, 516 bp, Homo sapiens
  misc_feature: HIJSMM301AJ0QW.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaaggctgaccgtcctaagtcagcccaaggctgccccctcggtcactctgttcccaccctcctcg

SEQ ID NO: 575244 - DNA, 503 bp, Homo sapiens
  misc_feature: HIJSMM301A41TI.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtacaacgaactgtggctgcaccatctgtcttcatt

SEQ ID NO: 575245 - DNA, 485 bp, Homo sapiens; identical to SEQ ID NO: 551636
  misc_feature: HIJSMM301DEISY.3.10.A10.1.454.light.4.raw

SEQ ID NO: 575246 - DNA, 494 bp, Homo sapiens; identical to SEQ ID NO: 567692
  misc_feature: HIJSMM301CFPI5.51.81.H04.1.454.light.4.raw

SEQ ID NO: 575247 - DNA, 504 bp, Homo sapiens; identical to SEQ ID NO: 535561
  misc_feature: HIJSMM301DZG3C.4.57.F02.1.454.light.4.raw

SEQ ID NO: 575248 - DNA, 444 bp, Homo sapiens; identical to SEQ ID NO: 537971
  misc_feature: HIJSMM301EU84I.2.76.G10.1.454.light.4.raw

SEQ ID NO: 575249 - DNA, 461 bp, Homo sapiens
  misc_feature: HIJSMM301ALJA8.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccagggctgaccgtcctaggtcagcccaaggctgccccctcggtcactctgttcccaccctcctcacgcgtatgt

SEQ ID NO: 575250 - DNA, 502 bp, Homo sapiens; identical to SEQ ID NO: 545020
  misc_feature: HIJSMM301AF90V.18.11.A11.1.454.light.4.raw

SEQ ID NO: 575251 - DNA, 505 bp, Homo sapiens; identical to SEQ ID NO: 535503
  misc_feature: HIJSMM301CQUGU.8.28.C06.1.454.light.4.raw

SEQ ID NO: 575252 - DNA, 515 bp, Homo sapiens
  misc_feature: HIJSMM301BSXPU.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccaccctcctcgacc

SEQ ID NO: 575253 - DNA, 500 bp, Homo sapiens
  misc_feature: HIJSMM301B0KU5.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgtcggtttattactgtcagcagtataataactggcctccacggtactacttttggccgaggggaccaagctggagatcaaacgaactgtggctgcaccatctgt

SEQ ID NO: 575254 - DNA, 483 bp, Homo sapiens; identical to SEQ ID NO: 535413
  misc_feature: HIJSMM301BO81C.26.78.H01.1.454.light.4.raw

SEQ ID NO: 575255 - DNA, 505 bp, Homo sapiens
  misc_feature: HIJSMM301CCI75.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagttattactgtcagcaatatttcgttgtctccgtacacttttggtccgtacgggacccgacggtggaggatcagacgaactgtggctgcaccatctgggtcttctatcttcccgt

SEQ ID NO: 575256 - DNA, 497 bp, Homo sapiens; identical to SEQ ID NO: 535664
  misc_feature: HIJSMM301AFXXO.22.14.B03.1.454.light.4.raw

SEQ ID NO: 575257 - DNA, 479 bp, Homo sapiens; identical to SEQ ID NO: 535665
  misc_feature: HIJSMM301BPF0L.12.10.A10.1.454.light.4.raw

SEQ ID NO: 575258 - DNA, 497 bp, Homo sapiens
  misc_feature: HIJSMM301A75LU.40.57.F02.1.454.light.4.raw
tctagcgactcacgaccggtgctcgatttagctcgatatagttggggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggccgagctgaccgtcctacgtcagcccaaggctcg

SEQ ID NO: 575259 - DNA, 495 bp, Homo sapiens; identical to SEQ ID NO: 535007
  misc_feature: HIJSMM301AHCR0.22.5.A05.1.454.light.4.raw

SEQ ID NO: 575260 - DNA, 510 bp, Homo sapiens
  misc_feature: HIJSMM301A05GM.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttgtggtgctgtgctattcggcggagggaccaagctgaccgtcttaagtcagcccaaggctgccccctccggtcactctgttccgt

SEQ ID NO: 575261 - DNA, 501 bp, Homo sapiens
  misc_feature: HIJSMM301EITB8.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatacaaacgaactgtggctgcaccatctgtcttcatccttcccgccatctacgata

SEQ ID NO: 575262 - DNA, 501 bp, Homo sapiens
  misc_feature: HIJSMM301BVTLN.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggcccaggggaccaagctggagatcaaacgaactgtggctgcaccatctgtcttcatt

SEQ ID NO: 575263 - DNA, 504 bp, Homo sapiens; identical to SEQ ID NO: 550923
  misc_feature: HIJSMM301DETUA.51.2.A02.1.454.light.4.raw

SEQ ID NO: 575264 - DNA, 505 bp, Homo sapiens; identical to SEQ ID NO: 535503
  misc_feature: HIJSMM301BJSZV.8.28.C06.1.454.light.4.raw

SEQ ID NO: 575265 - DNA, 510 bp, Homo sapiens; identical to SEQ ID NO: 553863
  misc_feature: HIJSMM301CNBH3.16.46.E02.1.454.light.4.raw

SEQ ID NO: 575266 - DNA, 490 bp, Homo sapiens
  misc_feature: HIJSMM301AV4CB.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgaacgacggagatcagacgaactagtggcgtgcaccactctgtcttcta

SEQ ID NO: 575267 - DNA, 494 bp, Homo sapiens
  misc_feature: HIJSMM301C4RVB.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagattaacgaaactgtggctgcaccatctgtcttcatt

SEQ ID NO: 575268 - DNA, 469 bp, Homo sapiens
  misc_feature: HIJSMM301C8UQ5.49.4.A04.1.454.light.4.raw
agtcgagagacacgaccggtgctcgatttagagtagtgatcaggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatagtctcccgctcactttcggcggggggaccaaggtggagatcaagcgaactgt

SEQ ID NO: 575269 - DNA, 497 bp, Homo sapiens; identical to SEQ ID NO: 535664
  misc_feature: HIJSMM301EV9BM.22.14.B03.1.454.light.4.raw

SEQ ID NO: 575270 - DNA, 485 bp, Homo sapiens; identical to SEQ ID NO: 536582
  misc_feature: HIJSMM301EJT4N.3.46.E02.1.454.light.4.raw

SEQ ID NO: 575271 - DNA, 500 bp, Homo sapiens
  misc_feature: HIJSMM301DL2GU.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttccgccta

SEQ ID NO: 575272 - DNA, 523 bp, Homo sapiens
  misc_feature: HIJSMM301C3L4I.17.31.C09.1.454.light.4.raw
cgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcctacgtctacg

SEQ ID NO: 575273 - DNA, 447 bp, Homo sapiens; identical to SEQ ID NO: 535020
  misc_feature: HIJSMM301EUH2I.18.9.A09.1.454.light.4.raw

SEQ ID NO: 575274 - DNA, 454 bp, Homo sapiens; identical to SEQ ID NO: 535005
  misc_feature: HIJSMM301DEO97.19.86.H09.1.454.light.4.raw

SEQ ID NO: 575275 - DNA, 487 bp, Homo sapiens; identical to SEQ ID NO: 536206
  misc_feature: HIJSMM301B4HUI.47.38.D05.1.454.light.4.raw

SEQ ID NO: 575276 - DNA, 507 bp, Homo sapiens
  misc_feature: HIJSMM301EK3GB.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtt

SEQ ID NO: 575277 - DNA, 516 bp, Homo sapiens
  misc_feature: HIJSMM301DA52T.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggacaggtggcaatcaaccgaactgtggctgcaccatctgtcttcatcttccccg

SEQ ID NO: 575278 - DNA, 484 bp, Homo sapiens
  misc_feature: HIJSMM301EA13C.3.3.A03.1.454.light.4.raw
agacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcgcagccaggttcagtggcagtgggtctgggacagacttcactctctccatcaggaatctggagcctgaagattctgcaatttatttctgtcagcagcgtagcagctggcctcccactttcggcggagggaccaaggtggagatcaaacgaactgtggctgcaccatctgtt

SEQ ID NO: 575279 - DNA, 499 bp, Homo sapiens
  misc_feature: HIJSMM301A1BG0.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctcaaggctggcaacacggcctccctgaccgtctctgggctccaggctgaggatgaggctgattattattgcagctcatatgcaggcagttacaatgtgatattcgcggagggaccaaactgaccgtcctaggtcagcccaagctgccccctc

SEQ ID NO: 575280 - DNA, 487 bp, Homo sapiens; identical to SEQ ID NO: 536206
  misc_feature: HIJSMM301DQVUQ.47.38.D05.1.454.light.4.raw

SEQ ID NO: 575281 - DNA, 513 bp, Homo sapiens; identical to SEQ ID NO: 562804
  misc_feature: HIJSMM301AFD3M.10.80.H03.1.454.light.4.raw

SEQ ID NO: 575282 - DNA, 492 bp, Homo sapiens
  misc_feature: HIJSMM301DXALX.41.53.E09.1.454.light.4.raw
tctatactatcacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctgctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaagg

SEQ ID NO: 575283 - DNA, 498 bp, Homo sapiens; identical to SEQ ID NO: 563148
  misc_feature: HIJSMM301CKH1R.3.33.C11.1.454.light.4.raw

SEQ ID NO: 575284 - DNA, 505 bp, Homo sapiens; identical to SEQ ID NO: 550196
  misc_feature: HIJSMM301C5WJA.10.27.C05.1.454.light.4.raw

SEQ ID NO: 575285 - DNA, 485 bp, Homo sapiens
  misc_feature: HIJSMM301BPBWP.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatacagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagctggagatcaggcgaa

SEQ ID NO: 575286 - DNA, 489 bp, Homo sapiens
  misc_feature: HIJSMM301C9NW4.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttattttgtcaacaggctaacactttcccctcacttcggcggagggaccaaggtggagatcaagcgaactgtggctgcaccatctgtctt

SEQ ID NO: 575287 - DNA, 501 bp, Homo sapiens
  misc_feature: HIJSMM301DQNAX.22.15.B04.1.454.light.4.raw
acatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatctcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtca

SEQ ID NO: 575288 - DNA, 472 bp, Homo sapiens
  misc_feature: HIJSMM301BIGA9.17.39.D06.1.454.light.4.raw
  modified_base (438)..(438): a, c, t, g, unknown or other
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggctccgngacgtcgcaggacaggtgaatcaacgaactgtgg

SEQ ID NO: 575289 - DNA, 502 bp, Homo sapiens; identical to SEQ ID NO: 551357
  misc_feature: HIJSMM301CL7F1.9.12.B01.1.454.light.4.raw

SEQ ID NO: 575290 - DNA, 503 bp, Homo sapiens
  misc_feature: HIJSMM301AJAWT.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcagggaacagtagtcacgttgaccatcagtggagtccaggcagaagacgaggctgactattattgtcaagcagtagacagcagtggtccttatcgggtgttcggcgggggacgaagctgaccgtcctaggtcagcccaaggctgccccctccggtcactctgttccccg

SEQ ID NO: 575291 - DNA, 529 bp, Homo sapiens
  misc_feature: HIJSMM301DM2UA.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatagttgggttttggctagtttcggttgttcgggcgggacgggacccgaggtcgacccgtccttacgtcacgcccgaaggtcc

SEQ ID NO: 575292 - DNA, 500 bp, Homo sapiens; identical to SEQ ID NO: 540012
  misc_feature: HIJSMM301AW4FU.52.34.D01.1.454.light.4.raw

SEQ ID NO: 575293 - DNA, 361 bp, Homo sapiens; identical to SEQ ID NO: 536899
  misc_feature: HIJSMM301DNHL6.3.57.F02.1.454.light.4.raw

SEQ ID NO: 575294 - DNA, 487 bp, Homo sapiens
  misc_feature: HIJSMM301CVXRW.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaaggctgagatcaaacgaa

SEQ ID NO: 575295 - DNA, 474 bp, Homo sapiens
  misc_feature: HIJSMM301E0VNW.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggtccaacggacacgactggagattaaacgaa

SEQ ID NO: 575296 - DNA, 485 bp, Homo sapiens; identical to SEQ ID NO: 535880
  misc_feature: HIJSMM301BFFIE.7.75.G09.1.454.light.4.raw

SEQ ID NO: 575297 - DNA, 494 bp, Homo sapiens
  misc_feature: HIJSMM301BUW4I.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaagcccctaaggtcctgatctatgaggcatctaactttaaaactggtgtcccatcaaggttcagcggcagtggatctgggacagaattcactctcgccatcagcagcctgcagcctgatgattctgcaacttattactgccaacagtattatagttatcgggggtacgttcggccaagggaccaaggtggaaatacaaacgaactgtggctgcaccatctgtt

SEQ ID NO: 575298 - DNA, 485 bp, Homo sapiens; identical to SEQ ID NO: 569008
  misc_feature: HIJSMM301AUN9B.26.78.H01.1.454.light.4.raw

SEQ ID NO: 575299 - DNA, 480 bp, Homo sapiens
  misc_feature: HIJSMM301B5PIE.43.34.D01.1.454.light.4.raw
tgtgagtagtcacgaccggtgctcgatttagatcgtctgtgttgggtttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtccta

SEQ ID NO: 575300 - DNA, 483 bp, Homo sapiens; identical to SEQ ID NO: 540738
  misc_feature: HIJSMM301C69DN.48.85.H08.1.454.light.4.raw

SEQ ID NO: 575301 - DNA, 493 bp, Homo sapiens
  misc_feature: HIJSMM301DLCP0.21.46.E02.1.454.light.4.raw
tcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtcaaacagtagacagtagaggtactcattgggtgttcggcggagggaccaagctgaccgtcctaggtcagcccaaggctcgccccctcc

SEQ ID NO: 575302 - DNA, 444 bp, Homo sapiens; identical to SEQ ID NO: 535192
  misc_feature: HIJSMM301BPDAS.5.9.A09.1.454.light.4.raw

SEQ ID NO: 575303 - DNA, 418 bp, Homo sapiens; identical to SEQ ID NO: 536277
  misc_feature: HIJSMM301BXAVO.19.86.H09.1.454.light.4.raw

SEQ ID NO: 575304 - DNA, 505 bp, Homo sapiens; identical to SEQ ID NO: 535503
  misc_feature: HIJSMM301CJZOP.8.28.C06.1.454.light.4.raw

SEQ ID NO: 575305 - DNA, 510 bp, Homo sapiens
  misc_feature: HIJSMM301EWRHF.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtccactctgttccca

SEQ ID NO: 575306 - DNA, 511 bp, Homo sapiens
  misc_feature: HIJSMM301D8K38.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccggagggacaccgccgtggagagttaaacgtaactgtggctgaccaccactctgtt

SEQ ID NO: 575307 - DNA, 471 bp, Homo sapiens
  misc_feature: HIJSMM301AQBDC.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacatcaacgaa

SEQ ID NO: 575308 - DNA, 507 bp, Homo sapiens; identical to SEQ ID NO: 559315
  misc_feature: HIJSMM301ENL1X.47.55.E11.1.454.light.4.raw

SEQ ID NO: 575309 - DNA, 447 bp, Homo sapiens; identical to SEQ ID NO: 535201
  misc_feature: HIJSMM301CA0BC.18.9.A09.1.454.light.4.raw

SEQ ID NO: 575310 - DNA, 472 bp, Homo sapiens; identical to SEQ ID NO: 547803
  misc_feature: HIJSMM301DB8HE.5.34.D01.1.454.light.4.raw

SEQ ID NO: 575311 - DNA, 520 bp, Homo sapiens; identical to SEQ ID NO: 535686
  misc_feature: HIJSMM301DXI5B.41.19.B08.1.454.light.4.raw

SEQ ID NO: 575312 - DNA, 481 bp, Homo sapiens; identical to SEQ ID NO: 539249
  misc_feature: HIJSMM301AYCZW.11.76.G10.1.454.light.4.raw

SEQ ID NO: 575313 - DNA, 495 bp, Homo sapiens; identical to SEQ ID NO: 538269
  misc_feature: HIJSMM301EJ29K.9.1.A01.1.454.light.4.raw

SEQ ID NO: 575314 - DNA, 497 bp, Homo sapiens; identical to SEQ ID NO: 536371
  misc_feature: HIJSMM301ENE5M.16.78.H01.1.454.light.4.raw

SEQ ID NO: 575315 - DNA, 484 bp, Homo sapiens; identical to SEQ ID NO: 535400
  misc_feature: HIJSMM301DCNRQ.46.26.C04.1.454.light.4.raw

SEQ ID NO: 575316 - DNA, 502 bp, Homo sapiens; identical to SEQ ID NO: 538663
  misc_feature: HIJSMM301BQK7L.48.36.D03.1.454.light.4.raw

SEQ ID NO: 575317 - DNA, 485 bp, Homo sapiens
  misc_feature: HIJSMM301AQJ1D.40.83.H06.1.454.light.4.raw
tctagcgactcacgaccggtgctcgatttagatcacgtgcgtcgcggggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatggacggcagcctcagtgaatgggtgttcggcggagggaccaaactgtccgtcctaggtcagaccccg

SEQ ID NO: 575318 - DNA, 488 bp, Homo sapiens; identical to SEQ ID NO: 535990
  misc_feature: HIJSMM301A1S61.11.28.C06.1.454.light.4.raw

SEQ ID NO: 575319 - DNA, 454 bp, Homo sapiens; identical to SEQ ID NO: 536943
  misc_feature: HIJSMM301CZSXK.19.86.H09.1.454.light.4.raw

SEQ ID NO: 575320 - DNA, 448 bp, Homo sapiens; identical to SEQ ID NO: 540364
  misc_feature: HIJSMM301EPG81.18.9.A09.1.454.light.4.raw

SEQ ID NO: 575321 - DNA, 490 bp, Homo sapiens
  misc_feature: HIJSMM301EJXYX.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggagtcaaacgaactgtggctgcaccatctgtcttcatt

SEQ ID NO: 575322 - DNA, 487 bp, Homo sapiens; identical to SEQ ID NO: 537220
  misc_feature: HIJSMM301DNLOH.16.53.E09.1.454.light.4.raw

SEQ ID NO: 575323 - DNA, 492 bp, Homo sapiens
  misc_feature: HIJSMM301DUI9G.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaaatgaactgtgctgcaccatctgtctt

SEQ ID NO: 575324 - DNA, 491 bp, Homo sapiens
  misc_feature: HIJSMM301ADPWP.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctctacttcggcggagggaccgagggtggagatcagacgaactgtggctgcaccatctgt

SEQ ID NO: 575325 - DNA, 509 bp, Homo sapiens; identical to SEQ ID NO: 540180
  misc_feature: HIJSMM301BBZ5A.5.60.F05.1.454.light.4.raw

SEQ ID NO: 575326 - DNA, 513 bp, Homo sapiens
  misc_feature: HIJSMM301EOP58.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccacgtttccggcccgtcgggaccaaacgtaggatatacaaacgaactagtggctgcaccatctgtt

SEQ ID NO: 575327 - DNA, 479 bp, Homo sapiens; identical to SEQ ID NO: 538734
  misc_feature: HIJSMM301AS0LE.8.53.E09.1.454.light.4.raw

SEQ ID NO: 575328 - DNA, 480 bp, Homo sapiens
  misc_feature: HIJSMM301AJ07S.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccgaagctgaccgtcctaggtcag

SEQ ID NO: 575329 - DNA, 495 bp, Homo sapiens
  misc_feature: HIJSMM301A7EK7.41.16.B05.1.454.light.4.raw
tctatactatcacgaccggtgctcgatttagagctcacgtaaggggggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccagactcccaggctcctcatctatcgtgcgtccaccagggcaactggtatcccagccaggttcagtggcgttgggtctgggacagagttcactctcaccatcaccagcctgcagtctgaagattttgcagtttacttactgtcaccaatataataactggtacacttttggccagggaccaagctcgagatcaaacgaactgtggctgcaccatctgtcttcatcttcccgccta

SEQ ID NO: 575330 - DNA, 495 bp, Homo sapiens; identical to SEQ ID NO: 535007
  misc_feature: HIJSMM301BVS79.22.5.A05.1.454.light.4.raw

SEQ ID NO: 575331 - DNA, 489 bp, Homo sapiens; identical to SEQ ID NO: 535139
  misc_feature: HIJSMM301BBZ56.14.55.E11.1.454.light.4.raw

SEQ ID NO: 575332 - DNA, 488 bp, Homo sapiens
  misc_feature: HIJSMM301DLQW5.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagacgtcttatttataaggtctctgaccgggactctggggtcccagacagattcagcggcagtgggtcagacactgatttcacactgaaaatcagcaggtggaggctgaggatgtcgggtttactactgcatgcagggtacactctggccgttcacttttggccaggggaccaaactggatatcagacgaactgtggctgca

SEQ ID NO: 575333 - DNA, 512 bp, Homo sapiens
  misc_feature: HIJSMM301DG0T8.48.17.B06.1.454.light.4.raw
agtatacatacacgaccggtgctcgatttagtcgatagtgaagggggctggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgtt

SEQ ID NO: 575334 - DNA, 482 bp, Homo sapiens; identical to SEQ ID NO: 542083
  misc_feature: HIJSMM301DYCMH.5.39.D06.1.454.light.4.raw

SEQ ID NO: 575335 - DNA, 506 bp, Homo sapiens
  misc_feature: HIJSMM301BY1SM.15.86.H09.1.454.light.4.raw
  modified_base (427)..(427): a, c, t, g, unknown or other
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaagacggttgggtnttcggcggagggaccaagctgaccgtcctaggtcagcccaaggctgccccctcggtcactctgttccccgccctcctcg

SEQ ID NO: 575336 - DNA, 456 bp, Homo sapiens
  misc_feature: HIJSMM301A1PVS.19.71.G05.1.454.light.4.raw
tactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatctttcccgccatctgacacgagagta

SEQ ID NO: 575337 - DNA, 490 bp, Homo sapiens
  misc_feature: HIJSMM301CY8DS.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagtttacccgcttcagtttcggcggagggaccaaggtggagatcaaacgaactgtggctgcaccatctgtcttcta

SEQ ID NO: 575338 - DNA, 522 bp, Homo sapiens; identical to SEQ ID NO: 543470
  misc_feature: HIJSMM301AMJ19.5.27.C05.1.454.light.4.raw

SEQ ID NO: 575339 - DNA, 491 bp, Homo sapiens; identical to SEQ ID NO: 535294
  misc_feature: HIJSMM301C7GCB.16.68.G02.1.454.light.4.raw

SEQ ID NO: 575340 - DNA, 487 bp, Homo sapiens; identical to SEQ ID NO: 536206
  misc_feature: HIJSMM301DEFFG.47.38.D05.1.454.light.4.raw

SEQ ID NO: 575341 - DNA, 505 bp, Homo sapiens; identical to SEQ ID NO: 535503
  misc_feature: HIJSMM301DHOZL.8.28.C06.1.454.light.4.raw

SEQ ID NO: 575342 - DNA, 441 bp, Homo sapiens; identical to SEQ ID NO: 534971
  misc_feature: HIJSMM301B9RGF.11.3.A03.1.454.light.4.raw

SEQ ID NO: 575343 - DNA, 491 bp, Homo sapiens; identical to SEQ ID NO: 569401
  misc_feature: HIJSMM301AV9FD.22.65.F10.1.454.light.4.raw

SEQ ID NO: 575344 - DNA, 502 bp, Homo sapiens
  misc_feature: HIJSMM301C4I8A.43.15.B04.1.454.light.4.raw
tgtgagtagtcacgaccggtgctcgatttagacagtatatatccgcggggggtcagagctctggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaaggggacttcggccaagggaccaaggtggaattcaaccgaactgtggctgcaccat

SEQ ID NO: 575345 - DNA, 509 bp, Homo sapiens; identical to SEQ ID NO: 547302
  misc_feature: HIJSMM301DUD5P.4.57.F02.1.454.light.4.raw

SEQ ID NO: 575346 - DNA, 486 bp, Homo sapiens; identical to SEQ ID NO: 535043
  misc_feature: HIJSMM301BP03N.46.35.D02.1.454.light.4.raw

SEQ ID NO: 575347 - DNA, 445 bp, Homo sapiens
  misc_feature: HIJSMM301CYZVF.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttccccaccctcctcagacgtatca

SEQ ID NO: 575348 - DNA, 486 bp, Homo sapiens; identical to SEQ ID NO: 553608
  misc_feature: HIJSMM301AVV93.11.12.B01.1.454.light.4.raw

SEQ ID NO: 575349 - DNA, 472 bp, Homo sapiens; identical to SEQ ID NO: 536302
  misc_feature: HIJSMM301CLKTA.18.76.G10.1.454.light.4.raw

SEQ ID NO: 575350 - DNA, 487 bp, Homo sapiens
  misc_feature: HIJSMM301BQKEB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcaagacgaa

SEQ ID NO: 575351 - DNA, 444 bp, Homo sapiens; identical to SEQ ID NO: 535411
  misc_feature: HIJSMM301C7IB2.8.73.G07.1.454.light.4.raw

SEQ ID NO: 575352 - DNA, 504 bp, Homo sapiens; identical to SEQ ID NO: 555616
  misc_feature: HIJSMM301A2Q7H.5.86.H09.1.454.light.4.raw

SEQ ID NO: 575353 - DNA, 474 bp, Homo sapiens
  misc_feature: HIJSMM301ENHO5.5.4.A04.1.454.light.4.raw
atcagacacgcacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggacaagtcagagcattagcaggtctttaaattggtatcagcacaaaccagggaaagcccctatgctcctgatctttgctgcatccagtttgcaaagtggggtcccatcaaggttcagtggcagtggatctgggacagatttcactctcaccatcagcagtctgcaagctgaagattttgcaacttattactgtcaacaaagttatagtaccccgacgttcggtccaaggaccaacggtggagatcaaacgaactagtggctgcacc

SEQ ID NO: 575354 - DNA, 503 bp, Homo sapiens; identical to SEQ ID NO: 536834
  misc_feature: HIJSMM301BU0QZ.2.35.D02.1.454.light.4.raw

SEQ ID NO: 575355 - DNA, 486 bp, Homo sapiens; identical to SEQ ID NO: 535043
  misc_feature: HIJSMM301CML4D.46.35.D02.1.454.light.4.raw

SEQ ID NO: 575356 - DNA, 476 bp, Homo sapiens; identical to SEQ ID NO: 538611
  misc_feature: HIJSMM301BB2RK.7.81.H04.1.454.light.4.raw

SEQ ID NO: 575357 - DNA, 493 bp, Homo sapiens
  misc_feature: HIJSMM301CBO3E.41.23.C01.1.454.light.4.raw
tctatactatcacgaccggtgctcgatttagtacacgtgattagggattgggggctgtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttagttgggtgttcggcggagggaccaaggctgaccgtccttggtcagcccaaggctccgg

SEQ ID NO: 575358 - DNA, 504 bp, Homo sapiens; identical to SEQ ID NO: 570955
  misc_feature: HIJSMM301D85Q7.8.71.G05.1.454.light.4.raw

SEQ ID NO: 575359 - DNA, 506 bp, Homo sapiens
  misc_feature: HIJSMM301D5BNU.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccactgtgatcttcggcggggggccaagctgaccgtcctaggtcagcccaaggctgcccccg

SEQ ID NO: 575360 - DNA, 491 bp, Homo sapiens; identical to SEQ ID NO: 538388
  misc_feature: HIJSMM301EZNMN.51.81.H04.1.454.light.4.raw

SEQ ID NO: 575361 - DNA, 484 bp, Homo sapiens; identical to SEQ ID NO: 536162
  misc_feature: HIJSMM301B9BNZ.13.59.F04.1.454.light.4.raw

SEQ ID NO: 575362 - DNA, 493 bp, Homo sapiens; identical to SEQ ID NO: 535745
  misc_feature: HIJSMM301DPW0P.47.78.H01.1.454.light.4.raw

SEQ ID NO: 575363 - DNA, 494 bp, Homo sapiens; identical to SEQ ID NO: 534992
  misc_feature: HIJSMM301AEM28.9.1.A01.1.454.light.4.raw

SEQ ID NO: 575364 - DNA, 501 bp, Homo sapiens
  misc_feature: HIJSMM301AZ6ZI.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggcccatcagtgggctccgggccgaggatgaggctgattattactgtgcaggatgggatgacaacctgggtgcttatctcttcggacctggaccaaggtcacgtcctggt

SEQ ID NO: 575365 - DNA, 497 bp, Homo sapiens
  misc_feature: HIJSMM301B9AZN.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgatttattactgcagctcatatacaagcaccagcactctctatgtcttcggaactgggaccaaggtcaccgtcctaggtcagcccaagg

SEQ ID NO: 575366 - DNA, 501 bp, Homo sapiens
  misc_feature: HIJSMM301CYUKB.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagtgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgtt

SEQ ID NO: 575367 - DNA, 504 bp, Homo sapiens
  misc_feature: HIJSMM301C5XKD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaactgtggctgcaccatctgtcttcatcttccccg

SEQ ID NO: 575368 - DNA, 504 bp, Homo sapiens
  misc_feature: HIJSMM301A5SHG.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccca

SEQ ID NO: 575369 - DNA, 487 bp, Homo sapiens
  misc_feature: HIJSMM301EDHMY.15.28.C06.1.454.light.4.raw
tctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgatttttgcaacttactactgccaagtgcataataatcatttcggcgagggaccaaggtggagatcaaacgaactgtggctgcaccatctgtcttcatt

SEQ ID NO: 575370 - DNA, 447 bp, Homo sapiens; identical to SEQ ID NO: 535201
  misc_feature: HIJSMM301DD3VC.18.9.A09.1.454.light.4.raw

SEQ ID NO: 575371 - DNA, 500 bp, Homo sapiens
  misc_feature: HIJSMM301BMV91.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactc

SEQ ID NO: 575372 - DNA, 521 bp, Homo sapiens
  misc_feature: HIJSMM301BL5K6.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacacccttgctcttcggaactgggaccacggtcatcgtcctaggtcagcccaaggccaaccccactgtcactctgttcccgccctcct

SEQ ID NO: 575373 - DNA, 497 bp, Homo sapiens; identical to SEQ ID NO: 538030
  misc_feature: HIJSMM301EYVS2.40.23.C01.1.454.light.4.raw

SEQ ID NO: 575374 - DNA, 496 bp, Homo sapiens; identical to SEQ ID NO: 535109
  misc_feature: HIJSMM301EF2KH.16.78.H01.1.454.light.4.raw

SEQ ID NO: 575375 - DNA, 514 bp, Homo sapiens; identical to SEQ ID NO: 545978
  misc_feature: HIJSMM301E2A4I.17.33.C11.1.454.light.4.raw

SEQ ID NO: 575376 - DNA, 494 bp, Homo sapiens; identical to SEQ ID NO: 536886
  misc_feature: HIJSMM301EAIHC.10.33.C11.1.454.light.4.raw

SEQ ID NO: 575377 - DNA, 490 bp, Homo sapiens; identical to SEQ ID NO: 535234
  misc_feature: HIJSMM301DH9MU.17.21.B10.1.454.light.4.raw

SEQ ID NO: 575378 - DNA, 481 bp, Homo sapiens
  misc_feature: HIJSMM301A0OID.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaaggacacgggtggaagtcaaacgaactagtggctgcaccat

SEQ ID NO: 575379 - DNA, 486 bp, Homo sapiens; identical to SEQ ID NO: 540131
  misc_feature: HIJSMM301D9JUS.52.23.C01.1.454.light.4.raw

SEQ ID NO: 575380 - DNA, 489 bp, Homo sapiens; identical to SEQ ID NO: 535139
  misc_feature: HIJSMM301DFYTS.14.55.E11.1.454.light.4.raw

SEQ ID NO: 575381 - DNA, 506 bp, Homo sapiens; identical to SEQ ID NO: 569322
  misc_feature: HIJSMM301EQ2ZN.18.78.H01.1.454.light.4.raw

SEQ ID NO: 575382 - DNA, 485 bp, Homo sapiens
  misc_feature: HIJSMM301EP3FO.46.35.D02.1.454.light.4.raw
  modified_base (196)..(196): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaanagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaacttttggccaggggaccaagctggagatcaaacgaactgtggctgcaccat

SEQ ID NO: 575383 - DNA, 485 bp, Homo sapiens
  misc_feature: HIJSMM301CQYP5.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcgccctgggaccatagtggatatgaaacgaactgtggctgcacc

SEQ ID NO: 575384 - DNA, 463 bp, Homo sapiens; identical to SEQ ID NO: 535062
  misc_feature: HIJSMM301BJD9S.11.73.G07.1.454.light.4.raw

SEQ ID NO: 575385 - DNA, 495 bp, Homo sapiens
  misc_feature: HIJSMM301BQRF4.51.28.C06.1.454.light.4.raw
cgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcaggggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctgccccctcggtcacc

SEQ ID NO: 575386 - DNA, 503 bp, Homo sapiens
  misc_feature: HIJSMM301AEUCV.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgtcgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtaggaaattaaagaaactgtggctgcaccatctgtcttcatcttcccgt

SEQ ID NO: 575387 - DNA, 492 bp, Homo sapiens; identical to SEQ ID NO: 536087
  misc_feature: HIJSMM301DSYK9.10.17.B06.1.454.light.4.raw

SEQ ID NO: 575388 - DNA, 494 bp, Homo sapiens; identical to SEQ ID NO: 536221
  misc_feature: HIJSMM301BRQ8B.15.59.F04.1.454.light.4.raw

SEQ ID NO: 575389 - DNA, 496 bp, Homo sapiens
  misc_feature: HIJSMM301AMAM2.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcaccatctgtctt

SEQ ID NO: 575390 - DNA, 480 bp, Homo sapiens
  misc_feature: HIJSMM301EYEWO.48.34.D01.1.454.light.4.raw
agtatacatacacgaccggtgctcgatttagatcgtctgtgttgggtttggggagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaacgaactgtgg

SEQ ID NO: 575391 - DNA, 491 bp, Homo sapiens; identical to SEQ ID NO: 539402
  misc_feature: HIJSMM301DMFSE.13.5.A05.1.454.light.4.raw

SEQ ID NO: 575392 - DNA, 495 bp, Homo sapiens; identical to SEQ ID NO: 543094
  misc_feature: HIJSMM301AVK70.22.57.F02.1.454.light.4.raw

SEQ ID NO: 575393 - DNA, 485 bp, Homo sapiens
  misc_feature: HIJSMM301D0ABT.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatcccaccagggccaccggtatcccagccaggttcagtggcagtgggtctgggacagagttcactctcaccatcagcagcctgcagtctgaggattttgcagtttattactgtcagcattacaataactggcctcggctcactttggcggagggaccaaggtggagatcaaacgaactgtggctgcacat

SEQ ID NO: 575394 - DNA, 520 bp, Homo sapiens
  misc_feature: HIJSMM301E2NM6.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaaagtcagcccaacggctgccccctccggtcactctgttcccacccctccctt

SEQ ID NO: 575395 - DNA, 497 bp, Homo sapiens; identical to SEQ ID NO: 535286
  misc_feature: HIJSMM301BK81B.18.59.F04.1.454.light.4.raw

SEQ ID NO: 575396 - DNA, 511 bp, Homo sapiens
  misc_feature: HIJSMM301CP8KY.48.35.D02.1.454.light.4.raw
agtatacatacacgaccggtgctcgatttagcacacgatagttgggtttgggggggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgcctcct

SEQ ID NO: 575397 - DNA, 494 bp, Homo sapiens; identical to SEQ ID NO: 534994
  misc_feature: HIJSMM301AIMT3.27.78.H01.1.454.light.4.raw

SEQ ID NO: 575398 - DNA, 513 bp, Homo sapiens; identical to SEQ ID NO: 541387
  misc_feature: HIJSMM301C7H1N.17.33.C11.1.454.light.4.raw

SEQ ID NO: 575399 - DNA, 447 bp, Homo sapiens
  misc_feature: HIJSMM301EN73E.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactaggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtgttcgtatgtcttcggatctgggaccaaggtcaccgtcctaagtcagcccaaggccaacccctctgtcactctgttcccaccctcctccatactcgta

SEQ ID NO: 575400 - DNA, 487 bp, Homo sapiens
  misc_feature: HIJSMM301CF6A3.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttagttactgtatgcaaggtatagagcttcctccgacgttcggccaagggaccaaggtggaactcaacgaa

SEQ ID NO: 575401 - DNA, 494 bp, Homo sapiens
  misc_feature: HIJSMM301AJ8GB.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgaccgttcggccaagggaccaaggtggagatcaaacgaactgtggctgcacat

SEQ ID NO: 575402 - DNA, 479 bp, Homo sapiens; identical to SEQ ID NO: 553343
  misc_feature: HIJSMM301ENMJA.43.12.B01.1.454.light.4.raw

SEQ ID NO: 575403 - DNA, 503 bp, Homo sapiens; identical to SEQ ID NO: 568855
  misc_feature: HIJSMM301ESSLW.9.71.G05.1.454.light.4.raw

SEQ ID NO: 575404 - DNA, 494 bp, Homo sapiens; identical to SEQ ID NO: 558792
  misc_feature: HIJSMM301BUXEI.10.79.H02.1.454.light.4.raw

SEQ ID NO: 575405 - DNA, 502 bp, Homo sapiens
  misc_feature: HIJSMM301ERL3W.49.41.D08.1.454.light.4.raw
agtcgagagacacgaccggtgctcgatttagtcacgcgagaaagggaaaggggatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaacgaactgtggctgcaccatctgtcttcatcttcccgccat

SEQ ID NO: 575406 - DNA, 510 bp, Homo sapiens
  misc_feature: HIJSMM301DBIZR.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcctttggcgcctttaacagggccagtggaatcccagccaggttcagcggcagtgggtctgggacttcgttcactctcaccatcaataacctgcaatctgacgactttgcagtttattctgtcagcagtctgaagactggccgttcactttcggcggagggaccaaggtggacctcaaacgaactgtggctgcaccatctgtcttcatccttcccgccactc

SEQ ID NO: 575407 - DNA, 505 bp, Homo sapiens; identical to SEQ ID NO: 535987
  misc_feature: HIJSMM301B464C.18.37.D04.1.454.light.4.raw

SEQ ID NO: 575408 - DNA, 445 bp, Homo sapiens
  misc_feature: HIJSMM301DDVVX.47.85.H08.1.454.light.4.raw
  modified_base (427)..(427): a, c, t, g, unknown or other
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccnccctcctctacgtgagct

SEQ ID NO: 575409 - DNA, 495 bp, Homo sapiens; identical to SEQ ID NO: 535007
  misc_feature: HIJSMM301BQUGE.22.5.A05.1.454.light.4.raw

SEQ ID NO: 575410 - DNA, 516 bp, Homo sapiens
  misc_feature: HIJSMM301CSA49.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaaggtggcaatcaaccgactgtggctgcaccatctgtcttcatcttccccg

SEQ ID NO: 575411 - DNA, 478 bp, Homo sapiens; identical to SEQ ID NO: 541928
  misc_feature: HIJSMM301DMIWN.7.76.G10.1.454.light.4.raw

SEQ ID NO: 575412 - DNA, 484 bp, Homo sapiens; identical to SEQ ID NO: 535400
  misc_feature: HIJSMM301C3UIN.46.26.C04.1.454.light.4.raw

SEQ ID NO: 575413 - DNA, 485 bp, Homo sapiens; identical to SEQ ID NO: 536210
  misc_feature: HIJSMM301BJ0EN.43.54.E10.1.454.light.4.raw

SEQ ID NO: 575414 - DNA, 491 bp, Homo sapiens; identical to SEQ ID NO: 561247
  misc_feature: HIJSMM301A34CF.4.52.E08.1.454.light.4.raw

SEQ ID NO: 575415 - DNA, 481 bp, Homo sapiens; identical to SEQ ID NO: 535993
  misc_feature: HIJSMM301EAR80.21.25.C03.1.454.light.4.raw

SEQ ID NO: 575416 - DNA, 488 bp, Homo sapiens; identical to SEQ ID NO: 537673
  misc_feature: HIJSMM301DPDMW.12.31.C09.1.454.light.4.raw

SEQ ID NO: 575417 - DNA, 514 bp, Homo sapiens; identical to SEQ ID NO: 538515
  misc_feature: HIJSMM301DVH9B.17.37.D04.1.454.light.4.raw

SEQ ID NO: 575418 - DNA, 485 bp, Homo sapiens
  misc_feature: HIJSMM301CYJ6C.52.23.C01.1.454.light.4.raw
cgcagtacgacacgaccggtgctcgatttagtacacgtgattagggattgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctcccctcactttcggcggaggaccaaggtggagatcagacgaactgtggctgcacca

SEQ ID NO: 575419 - DNA, 504 bp, Homo sapiens; identical to SEQ ID NO: 555965
  misc_feature: HIJSMM301CGYR5.48.36.D03.1.454.light.4.raw

SEQ ID NO: 575420 - DNA, 518 bp, Homo sapiens; identical to SEQ ID NO: 539372
  misc_feature: HIJSMM301A929E.7.86.H09.1.454.light.4.raw

SEQ ID NO: 575421 - DNA, 444 bp, Homo sapiens; identical to SEQ ID NO: 535042
  misc_feature: HIJSMM301B8DXI.10.76.G10.1.454.light.4.raw

SEQ ID NO: 575422 - DNA, 519 bp, Homo sapiens
  misc_feature: HIJSMM301CYDSY.48.23.C01.1.454.light.4.raw
agtatacatacacgaccggtgctcgatttagtacacgtgattagggattggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgattttattgtgctgtttgggatgacgacatgaatggttcgattttcggcggagggaccaaactgaccgtcctgggtcagcccaaggctgccccctcggtcactctgttcccaccctcctcta

SEQ ID NO: 575423 - DNA, 521 bp, Homo sapiens
  misc_feature: HIJSMM301BT9CO.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggacgcctcagttggaagcagccgatccagcctgcggagcctgtggggcaggtcagcccaaggctcgccccctcggtcactctcgttcccaccctcctccacg

SEQ ID NO: 575424 - DNA, 481 bp, Homo sapiens
  misc_feature: HIJSMM301AVU1F.17.34.D01.1.454.light.4.raw
  modified_base (425)..(425): a, c, t, g, unknown or other
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttatactgtatgcaaggtatagagcttcctccgacgttcggccaaggaccaaggtggaactnaaacgaactgtggctgcaccatctgtcttcatcttccgccatctgactagtctacg

SEQ ID NO: 575425 - DNA, 498 bp, Homo sapiens
  misc_feature: HIJSMM301CW3S3.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaacgaactagtggctgcacccactctgtctt

SEQ ID NO: 575426 - DNA, 484 bp, Homo sapiens; identical to SEQ ID NO: 535400
  misc_feature: HIJSMM301CEPWW.46.26.C04.1.454.light.4.raw

SEQ ID NO: 575427 - DNA, 438 bp, Homo sapiens
  misc_feature: HIJSMM301B3W8Z.13.73.G07.1.454.light.4.raw
tcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtcctaggtcagcccaaggctgccccctcggtcactctgttcccaccctcctctagtacgtga

SEQ ID NO: 575428 - DNA, 508 bp, Homo sapiens; identical to SEQ ID NO: 552440
  misc_feature: HIJSMM301A476V.5.24.C02.1.454.light.4.raw

SEQ ID NO: 575429 - DNA, 508 bp, Homo sapiens
  misc_feature: HIJSMM301DXTDD.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccac

SEQ ID NO: 575430 - DNA, 504 bp, Homo sapiens; identical to SEQ ID NO: 539690
  misc_feature: HIJSMM301DC9OA.47.65.F10.1.454.light.4.raw

SEQ ID NO: 575431 - DNA, 489 bp, Homo sapiens; identical to SEQ ID NO: 549527
  misc_feature: HIJSMM301A6UAY.15.49.E05.1.454.light.4.raw

SEQ ID NO: 575432 - DNA, 460 bp, Homo sapiens; identical to SEQ ID NO: 537107
  misc_feature: HIJSMM301AT46Y.22.28.C06.1.454.light.4.raw

SEQ ID NO: 575433 - DNA, 382 bp, Homo sapiens
  misc_feature: HIJSMM301EROPO.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgcatctgaatagtataga

SEQ ID NO: 575434 - DNA, 497 bp, Homo sapiens
  misc_feature: HIJSMM301C8ZWU.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggaggaccaagctgaccgtcctaggtcagccaaggctgtccccccg

SEQ ID NO: 575435 - DNA, 444 bp, Homo sapiens; identical to SEQ ID NO: 535192
  misc_feature: HIJSMM301BPGWO.5.9.A09.1.454.light.4.raw

SEQ ID NO: 575436 - DNA, 490 bp, Homo sapiens
  misc_feature: HIJSMM301CNMLK.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatgtaggtcacctgggacttttggccagggacaagactggagatcaaacgaactgtgctgcacatctgtctt

SEQ ID NO: 575437 - DNA, 483 bp, Homo sapiens; identical to SEQ ID NO: 555750
  misc_feature: HIJSMM301DBPT3.41.78.H01.1.454.light.4.raw

SEQ ID NO: 575438 - DNA, 477 bp, Homo sapiens
  misc_feature: HIJSMM301DZVUP.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagatttgcaacttactttgtcaacaggctcagagtttcccgctcactttcggcggagggaccaaggtggagatcaaacgaactgtggctgca

SEQ ID NO: 575439 - DNA, 494 bp, Homo sapiens; identical to SEQ ID NO: 534994
  misc_feature: HIJSMM301BD3NQ.27.78.H01.1.454.light.4.raw

SEQ ID NO: 575440 - DNA, 444 bp, Homo sapiens; identical to SEQ ID NO: 536096
  misc_feature: HIJSMM301B28CK.7.18.B07.1.454.light.4.raw

SEQ ID NO: 575441 - DNA, 440 bp, Homo sapiens; identical to SEQ ID NO: 543785
  misc_feature: HIJSMM301BGW0Y.4.22.B11.1.454.light.4.raw

SEQ ID NO: 575442 - DNA, 487 bp, Homo sapiens
  misc_feature: HIJSMM301C4NW1.43.54.E10.1.454.light.4.raw
tgtgagtagtcacgaccggtgctcgatttagatcgtagcagaacacacaaagggggatcaggactcctcagttcaccttctcacaatgaggctccctgctcagctcctggggctgctaatgctctgggtcccaggatccattggggatattgtgctgactcagtctccactctccctctccgtcacccttggacagtcggtgtccatctcctgcaggtctagtcacagcgtcctacacagtgatggaagaacctacttggattggtttcagcagaggccaggccaatctccaaggctcctaatttataaggtttctagtcgggactctggggtcccagacagattcagcggcagtgggtcaggcactgacttcacactgaaaatcagtagtgtggaggctgaggatgttgccatttattactgcatgcaagggacacactggccgtacacttttggccaggggaccaagctggaggatacaaacgaa

SEQ ID NO: 575443 - DNA, 498 bp, Homo sapiens
  misc_feature: HIJSMM301BPY2M.21.38.D05.1.454.light.4.raw
tcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcat

SEQ ID NO: 575444 - DNA, 496 bp, Homo sapiens; identical to SEQ ID NO: 551761
  misc_feature: HIJSMM301AIHPM.4.27.C05.1.454.light.4.raw

SEQ ID NO: 575445 - DNA, 499 bp, Homo sapiens
  misc_feature: HIJSMM301B1UK2.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggtccaggggaccgaagctggagatcaaacgaaactgtggtcg

SEQ ID NO: 575446 - DNA, 514 bp, Homo sapiens
  misc_feature: HIJSMM301BSZCS.52.37.D04.1.454.light.4.raw
  modified_base (501)..(501): a, c, t, g, unknown or other
cgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaatacccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacaacttgggtgttcggcggcgggaccaaaactgaccgtcctacgtcagcccaaggctgcccccncggtcactcttcg

SEQ ID NO: 575447 - DNA, 451 bp, Homo sapiens
  misc_feature: HIJSMM301DRYRQ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttcggcggagggaccaagctgaccgtcctaagtcagcccaaggctgccccctggtcactctgttcccacctcctccacgagagta

SEQ ID NO: 575448 - DNA, 483 bp, Homo sapiens
  misc_feature: HIJSMM301AHRQC.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatagagacgaactgtggctgcaccat

SEQ ID NO: 575449 - DNA, 494 bp, Homo sapiens; identical to SEQ ID NO: 571366
  misc_feature: HIJSMM301CEBGV.51.12.B01.1.454.light.4.raw

SEQ ID NO: 575450 - DNA, 486 bp, Homo sapiens; identical to SEQ ID NO: 535523
  misc_feature: HIJSMM301CSIMM.22.73.G07.1.454.light.4.raw

SEQ ID NO: 575451 - DNA, 395 bp, Homo sapiens
  misc_feature: HIJSMM301ALEPM.49.53.E09.1.454.light.4.raw
agtcgagagacacgaccggtgctcgatttagagagagtgtgttgggtttggggtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 575452 - DNA, 494 bp, Homo sapiens; identical to SEQ ID NO: 534992
  misc_feature: HIJSMM301BQGU1.9.1.A01.1.454.light.4.raw

SEQ ID NO: 575453 - DNA, 514 bp, Homo sapiens
  misc_feature: HIJSMM301EHLGA.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtggaccaagctgaccgtcctaagtcagcccaaggctgccccctggtcactctgttccca

SEQ ID NO: 575454 - DNA, 500 bp, Homo sapiens; identical to SEQ ID NO: 542309
  misc_feature: HIJSMM301C6XID.12.86.H09.1.454.light.4.raw

SEQ ID NO: 575455 - DNA, 498 bp, Homo sapiens; identical to SEQ ID NO: 547944
  misc_feature: HIJSMM301EK0NG.41.53.E09.1.454.light.4.raw

SEQ ID NO: 575456 - DNA, 494 bp, Homo sapiens; identical to SEQ ID NO: 535478
  misc_feature: HIJSMM301A8QRS.10.79.H02.1.454.light.4.raw

SEQ ID NO: 575457 - DNA, 510 bp, Homo sapiens; identical to SEQ ID NO: 556652
  misc_feature: HIJSMM301DLVEM.17.28.C06.1.454.light.4.raw

SEQ ID NO: 575458 - DNA, 477 bp, Homo sapiens
  misc_feature: HIJSMM301ASXIS.13.76.G10.1.454.light.4.raw
tcacgtactacacgaccggtgctcgatttagtcactcatacagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagaccccg

SEQ ID NO: 575459 - DNA, 486 bp, Homo sapiens; identical to SEQ ID NO: 535043
  misc_feature: HIJSMM301CV3M8.46.35.D02.1.454.light.4.raw

SEQ ID NO: 575460 - DNA, 500 bp, Homo sapiens; identical to SEQ ID NO: 546613
  misc_feature: HIJSMM301AJ73Z.11.21.B10.1.454.light.4.raw

SEQ ID NO: 575461 - DNA, 498 bp, Homo sapiens
  misc_feature: HIJSMM301A9U39.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaaccca

SEQ ID NO: 575462 - DNA, 488 bp, Homo sapiens; identical to SEQ ID NO: 535990
  misc_feature: HIJSMM301DIE22.11.28.C06.1.454.light.4.raw

SEQ ID NO: 575463 - DNA, 480 bp, Homo sapiens; identical to SEQ ID NO: 535630
  misc_feature: HIJSMM301DHWO9.40.59.F04.1.454.light.4.raw

SEQ ID NO: 575464 - DNA, 485 bp, Homo sapiens
  misc_feature: HIJSMM301DXTSO.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggacacgactggagattaaacgaactgtggctgcaccat

SEQ ID NO: 575465 - DNA, 478 bp, Homo sapiens
  misc_feature: HIJSMM301A5N80.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggctgttcggcggcggac

SEQ ID NO: 575466 - DNA, 497 bp, Homo sapiens; identical to SEQ ID NO: 535286
  misc_feature: HIJSMM301AG5Y8.18.59.F04.1.454.light.4.raw

SEQ ID NO: 575467 - DNA, 505 bp, Homo sapiens
  misc_feature: HIJSMM301EW9OD.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaataagaggtcaaacgaactagtggctgcaccatctgtcttcat

SEQ ID NO: 575468 - DNA, 495 bp, Homo sapiens
  misc_feature: HIJSMM301BLJQK.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgctagtttattactgtcagtagcgtagcaactggcctctcaccttcggcggagggaccaagggtggagatcaaacgaactgtggctgcaccatctgtctt

SEQ ID NO: 575469 - DNA, 494 bp, Homo sapiens; identical to SEQ ID NO: 535276
  misc_feature: HIJSMM301ASLJQ.16.6.A06.1.454.light.4.raw

SEQ ID NO: 575470 - DNA, 481 bp, Homo sapiens; identical to SEQ ID NO: 535061
  misc_feature: HIJSMM301D5LAQ.16.81.H04.1.454.light.4.raw

SEQ ID NO: 575471 - DNA, 478 bp, Homo sapiens
  misc_feature: HIJSMM301CE7OQ.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggcctgggaccaatgtggatatcaaacgaactgtggctgcaccatct

SEQ ID NO: 575472 - DNA, 514 bp, Homo sapiens
  misc_feature: HIJSMM301ANRHZ.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaggtgcaatcaaccgaactgtgctgcaccatctgtcttcatcttcccg

SEQ ID NO: 575473 - DNA, 504 bp, Homo sapiens
  misc_feature: HIJSMM301EDWUT.53.33.C11.1.454.light.4.raw
cgcgtatacacacgaccggtgctcgatttagagtgagctcgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtgggcccaggtggaggatgaagctgattactactgttactcaacagacaggagtggaaaatcatagggtattcggcggagggaccaaaactgaccgtcctaggtcagcccaaggctgccccctcggtcactctcg

SEQ ID NO: 575474 - DNA, 464 bp, Homo sapiens; identical to SEQ ID NO: 537056
  misc_feature: HIJSMM301CNYEE.11.70.G04.1.454.light.4.raw

SEQ ID NO: 575475 - DNA, 485 bp, Homo sapiens
  misc_feature: HIJSMM301EVNT6.49.57.F02.1.454.light.4.raw
agtcgagagacacgaccggtgctcgatttagctcgatatagttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgaac

SEQ ID NO: 575476 - DNA, 519 bp, Homo sapiens
  misc_feature: HIJSMM301C5E6C.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccgcct

SEQ ID NO: 575477 - DNA, 486 bp, Homo sapiens; identical to SEQ ID NO: 535043
  misc_feature: HIJSMM301BH57N.46.35.D02.1.454.light.4.raw

SEQ ID NO: 575478 - DNA, 509 bp, Homo sapiens; identical to SEQ ID NO: 541829
  misc_feature: HIJSMM301BFSKT.17.28.C06.1.454.light.4.raw

SEQ ID NO: 575479 - DNA, 497 bp, Homo sapiens; identical to SEQ ID NO: 535740
  misc_feature: HIJSMM301BNFXB.3.71.G05.1.454.light.4.raw

SEQ ID NO: 575480 - DNA, 485 bp, Homo sapiens; identical to SEQ ID NO: 568562
  misc_feature: HIJSMM301DEAKN.7.75.G09.1.454.light.4.raw

SEQ ID NO: 575481 - DNA, 496 bp, Homo sapiens
  misc_feature: HIJSMM301EEYO5.48.58.F03.1.454.light.4.raw
agtatacatacacgaccggtgctcgatttagtctgatcgagaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggccaagggaccgaacggtaggaaacgtacaaacgaactagtgg

SEQ ID NO: 575482 - DNA, 498 bp, Homo sapiens
  misc_feature: HIJSMM301DQF7R.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtctgggtcagcccaaggctgccccctcggtcactctgttcccaccctcctctgtcgagcgt

SEQ ID NO: 575483 - DNA, 505 bp, Homo sapiens; identical to SEQ ID NO: 535503
  misc_feature: HIJSMM301C1SXU.8.28.C06.1.454.light.4.raw

SEQ ID NO: 575484 - DNA, 487 bp, Homo sapiens; identical to SEQ ID NO: 555321
  misc_feature: HIJSMM301ALVW6.19.71.G05.1.454.light.4.raw

SEQ ID NO: 575485 - DNA, 489 bp, Homo sapiens; identical to SEQ ID NO: 553430
  misc_feature: HIJSMM301CPQ3Z.14.55.E11.1.454.light.4.raw

SEQ ID NO: 575486 - DNA, 494 bp, Homo sapiens; identical to SEQ ID NO: 536477
  misc_feature: HIJSMM301DK8MS.22.5.A05.1.454.light.4.raw

SEQ ID NO: 575487 - DNA, 488 bp, Homo sapiens
  misc_feature: HIJSMM301AQAP4.48.45.E01.1.454.light.4.raw
agtatacatacacgaccggtgctcgatttagtgagtcagtaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 575488 - DNA, 493 bp, Homo sapiens; identical to SEQ ID NO: 535566
  misc_feature: HIJSMM301BO42T.16.6.A06.1.454.light.4.raw

SEQ ID NO: 575489 - DNA, 508 bp, Homo sapiens
  misc_feature: HIJSMM301CEHDD.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaaacgaactgtggctgcaccatctgtcttcatcttccccg

SEQ ID NO: 575490 - DNA, 490 bp, Homo sapiens
  misc_feature: HIJSMM301E10CL.49.81.H04.1.454.light.4.raw
agtcgagagacacgaccggtgctcgatttagtagtgtagattcgcgggcgtagactttgtgtttctcgtagtctccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtatttactttcaccatcatcaacctgcagcctgaggatattgcaacatattactgtcaacaatatgataatctaccactcactttcggcggagggaccgacggtggaggatcaaacgaactagtggctgcaccatctgtcttctatcttcccgtcca

SEQ ID NO: 575491 - DNA, 445 bp, Homo sapiens; identical to SEQ ID NO: 543784
  misc_feature: HIJSMM301ELQNQ.5.9.A09.1.454.light.4.raw

SEQ ID NO: 575492 - DNA, 463 bp, Homo sapiens; identical to SEQ ID NO: 535062
  misc_feature: HIJSMM301EP6A6.11.73.G07.1.454.light.4.raw

SEQ ID NO: 575493 - DNA, 518 bp, Homo sapiens
  misc_feature: HIJSMM301CLC5G.14.78.H01.1.454.light.4.raw
cgtctagtaccacgaccggtgctcgatttagtgtgagtagtttgggtttgggggggtcgacaagaggcagcgctctcgggacggtctccaccatggcctgggcgtctgctgctcctcactctcctcactcaggacacagggtccgtgggcccgagtctgccctgactcagcctgcctccgtgtctgggtctcctggacagtcgatcaccatctcctgcactgcaactaatggtgagattgggacttataaccttgtctcctggtaccaacaacatccagacaaagcccccaaacctcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgtt

SEQ ID NO: 575494 - DNA, 500 bp, Homo sapiens
  misc_feature: HIJSMM301DHOVN.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctggggtcagcccaa

SEQ ID NO: 575495 - DNA, 522 bp, Homo sapiens
  misc_feature: HIJSMM301AI3KF.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggccacggaccgaacggtaggaaagtactaagacgaacctagtggtcgtcggtcaccactactcgttcttctacttcttcccgt

SEQ ID NO: 575496 - DNA, 470 bp, Homo sapiens; identical to SEQ ID NO: 535655
  misc_feature: HIJSMM301CBX6L.18.76.G10.1.454.light.4.raw

SEQ ID NO: 575497 - DNA, 481 bp, Homo sapiens; identical to SEQ ID NO: 541494
  misc_feature: HIJSMM301C14FR.51.76.G10.1.454.light.4.raw

SEQ ID NO: 575498 - DNA, 519 bp, Homo sapiens; identical to SEQ ID NO: 541143
  misc_feature: HIJSMM301CB9PV.7.86.H09.1.454.light.4.raw

SEQ ID NO: 575499 - DNA, 498 bp, Homo sapiens; identical to SEQ ID NO: 540742
  misc_feature: HIJSMM301B8A3E.18.59.F04.1.454.light.4.raw

SEQ ID NO: 575500 - DNA, 506 bp, Homo sapiens; identical to SEQ ID NO: 566446
  misc_feature: HIJSMM301BK6Y3.10.29.C07.1.454.light.4.raw

SEQ ID NO: 575501 - DNA, 508 bp, Homo sapiens; identical to SEQ ID NO: 536062
  misc_feature: HIJSMM301DR5WR.11.57.F02.1.454.light.4.raw

SEQ ID NO: 575502 - DNA, 504 bp, Homo sapiens; identical to SEQ ID NO: 540636
  misc_feature: HIJSMM301CU0T1.19.67.G01.1.454.light.4.raw

SEQ ID NO: 575503 - DNA, 514 bp, Homo sapiens
  misc_feature: HIJSMM301BOE6P.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccgaacgggaccaaaggtaggaaatacaaacgaaactagtggtctgcaccactctgtcttctactcttccccg

SEQ ID NO: 575504 - DNA, 491 bp, Homo sapiens; identical to SEQ ID NO: 542310
  misc_feature: HIJSMM301BJ4K1.22.65.F10.1.454.light.4.raw

SEQ ID NO: 575505 - DNA, 474 bp, Homo sapiens
  misc_feature: HIJSMM301CPZAP.17.67.G01.1.454.light.4.raw
  modified_base (419)..(419): a, c, t, g, unknown or other
cgtagactagcacgaccggtgctcgatttagagtatacatattgggtttgggggcaggagtcagtctcagtcaggacacagcatggacatgagggtccccgctcaagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacanagtctcagtaccccccggacttcggccgagggaccgagggtggaaatcaaacgaa

SEQ ID NO: 575506 - DNA, 506 bp, Homo sapiens
  misc_feature: HIJSMM301CPTTK.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcta

SEQ ID NO: 575507 - DNA, 498 bp, Homo sapiens; identical to SEQ ID NO: 547576
  misc_feature: HIJSMM301EK4LD.12.37.D04.1.454.light.4.raw

SEQ ID NO: 575508 - DNA, 498 bp, Homo sapiens
  misc_feature: HIJSMM301BL4IF.4.68.G02.1.454.light.4.raw
agcactgtagcacgaccggtgctcgatttagtcgatagtgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacattggtggttataactatgtctcctggtaccagcaacacccaggcaaacgcccccaaactcatcgtttatgatgtcactgatcggccctcaggggtttctagtcgcttctctggctccaagtctggcaacacggcctccctgaccatctctgggctccaggctgaggacgaggctgattattactgcagctcatatacaagcagcagcactctgggggtattcggcggagggaccaagctgaccgtcctaggtcagcccaaggctcg

SEQ ID NO: 575509 - DNA, 485 bp, Homo sapiens; identical to SEQ ID NO: 535501
  misc_feature: HIJSMM301DR9HU.3.10.A10.1.454.light.4.raw

SEQ ID NO: 575510 - DNA, 488 bp, Homo sapiens
  misc_feature: HIJSMM301BAU6Y.52.3.A03.1.454.light.4.raw
cgcagtacgacacgaccggtgctcgatttagagagcgtcacagggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaagcccctaaactcctgatctctaaggcatctgatttacaaactggggtcccgtcaaggttcagcggcagtggatctgggacagacttcactctcaccatcagcagcctgcagcctgatgactttgcaagttattattgccaacagtataactagtttttcattcacttttggccctgggacgacagtggatatcaaacgaactgtggctgcaccatctgtcttcta

SEQ ID NO: 575511 - DNA, 508 bp, Homo sapiens
  misc_feature: HIJSMM301AVS3T.7.71.G05.1.454.light.4.raw
  modified_base (501)..(501): a, c, t, g, unknown or other
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgtacactctntcgtctt

SEQ ID NO: 575512 - DNA, 511 bp, Homo sapiens
  misc_feature: HIJSMM301AV7LB.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctgttcccgt

SEQ ID NO: 575513 - DNA, 521 bp, Homo sapiens; identical to SEQ ID NO: 539470
  misc_feature: HIJSMM301CGP4E.27.23.C01.1.454.light.4.raw

SEQ ID NO: 575514 - DNA, 509 bp, Homo sapiens; identical to SEQ ID NO: 536047
  misc_feature: HIJSMM301CABUU.17.33.C11.1.454.light.4.raw

SEQ ID NO: 575515 - DNA, 545 bp, Homo sapiens
  misc_feature: HIJSMM301CSWJW.14.86.H09.1.454.light.4.raw
cgtctagtaccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagccccgttacatcttcccgccatctgagta

SEQ ID NO: 575516 - DNA, 507 bp, Homo sapiens; identical to SEQ ID NO: 567373
  misc_feature: HIJSMM301EJ8U4.47.83.H06.1.454.light.4.raw

SEQ ID NO: 575517 - DNA, 521 bp, Homo sapiens; identical to SEQ ID NO: 563135
  misc_feature: HIJSMM301BV8EU.27.23.C01.1.454.light.4.raw

SEQ ID NO: 575518 - DNA, 490 bp, Homo sapiens
  misc_feature: HIJSMM301DVB9S.52.27.C05.1.454.light.4.raw
cgcagtacgacacgaccggtgctcgatttagacgcgatcgaagggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagttgacaatacccctcagactttcggccctggaccagagtggacatcaaacgaaactgtggctgcaccatctgtcttcatt

SEQ ID NO: 575519 - DNA, 504 bp, Homo sapiens; identical to SEQ ID NO: 538940
  misc_feature: HIJSMM301ARIRU.2.35.D02.1.454.light.4.raw

SEQ ID NO: 575520 - DNA, 489 bp, Homo sapiens; identical to SEQ ID NO: 543840
  misc_feature: HIJSMM301BESHF.12.88.H11.1.454.light.4.raw

SEQ ID NO: 575521 - DNA, 504 bp, Homo sapiens
  misc_feature: HIJSMM301D1SGC.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatactttgtcttcggaactgggaccaaggtcacgtcctaggtcagcccaaggccaacccactgtcact

SEQ ID NO: 575522 - DNA, 525 bp, Homo sapiens
  misc_feature: HIJSMM301D0LPF.41.87.H10.1.454.light.4.raw
tctatactatcacgaccggtgctcgatttagcagtactgcgttgggtttggggggggtcgtcaggaggcagcgctctcaggacgtcaccaccatggcctgggcgtctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaaatttcagggtatttggcggaggggaccaagctgaccgtcctgggtcagcccaaggctgccccctccggtcactctgttcccg

SEQ ID NO: 575523 - DNA, 491 bp, Homo sapiens; identical to SEQ ID NO: 536211
  misc_feature: HIJSMM301D3TK1.16.53.E09.1.454.light.4.raw

SEQ ID NO: 575524 - DNA, 489 bp, Homo sapiens
  misc_feature: HIJSMM301DE8OJ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgttctcta

SEQ ID NO: 575525 - DNA, 523 bp, Homo sapiens
  misc_feature: HIJSMM301CQL8L.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtccactctcgttcccgccct

SEQ ID NO: 575526 - DNA, 507 bp, Homo sapiens
  misc_feature: HIJSMM301BLDFL.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgcctacgtaga

SEQ ID NO: 575527 - DNA, 500 bp, Homo sapiens; identical to SEQ ID NO: 547405
  misc_feature: HIJSMM301E22P0.41.71.G05.1.454.light.4.raw

SEQ ID NO: 575528 - DNA, 485 bp, Homo sapiens
  misc_feature: HIJSMM301CUUXJ.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtgaggctgaagatgtcgggttattactgcatgcagggtacagtgtggccttcgctcgcattcggcggagggaccaaggtggagatcaaacgaa

SEQ ID NO: 575529 - DNA, 514 bp, Homo sapiens
  misc_feature: HIJSMM301AOJMT.49.71.G05.1.454.light.4.raw
agtcgagagacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactgtcactctgttcccaccctcct

SEQ ID NO: 575530 - DNA, 503 bp, Homo sapiens; identical to SEQ ID NO: 546075
  misc_feature: HIJSMM301EHQ1M.7.71.G05.1.454.light.4.raw

SEQ ID NO: 575531 - DNA, 502 bp, Homo sapiens; identical to SEQ ID NO: 543936
  misc_feature: HIJSMM301A9FY6.15.1.A01.1.454.light.4.raw

SEQ ID NO: 575532 - DNA, 506 bp, Homo sapiens; identical to SEQ ID NO: 564848
  misc_feature: HIJSMM301EV0C0.10.88.H11.1.454.light.4.raw

SEQ ID NO: 575533 - DNA, 507 bp, Homo sapiens; identical to SEQ ID NO: 557429
  misc_feature: HIJSMM301C9JMK.15.59.F04.1.454.light.4.raw

SEQ ID NO: 575534 - DNA, 511 bp, Homo sapiens; identical to SEQ ID NO: 544123
  misc_feature: HIJSMM301AE5V3.5.27.C05.1.454.light.4.raw

SEQ ID NO: 575535 - DNA, 486 bp, Homo sapiens; identical to SEQ ID NO: 535043
  misc_feature: HIJSMM301DULJ0.46.35.D02.1.454.light.4.raw

SEQ ID NO: 575536 - DNA, 490 bp, Homo sapiens
  misc_feature: HIJSMM301BM5VU.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctacaacctgaagattttgcaacttactactgtcaacagagttacggtaccccgtacacttttggccaggggaccaaactggacatcaaacgaactgtggctgcaccatctgtctt

SEQ ID NO: 575537 - DNA, 500 bp, Homo sapiens
  misc_feature: HIJSMM301C9ENI.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccaccctcccgctacgtaga

SEQ ID NO: 575538 - DNA, 484 bp, Homo sapiens
  misc_feature: HIJSMM301D0YO9.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttcccctcactttcgcggaggaccaaggtgagatcaagcgaactgtggctgcaccat

SEQ ID NO: 575539 - DNA, 506 bp, Homo sapiens
  misc_feature: HIJSMM301DDKMB.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatccggccctctaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccca

SEQ ID NO: 575540 - DNA, 497 bp, Homo sapiens; identical to SEQ ID NO: 539058
  misc_feature: HIJSMM301ADYI7.12.87.H10.1.454.light.4.raw

SEQ ID NO: 575541 - DNA, 483 bp, Homo sapiens
  misc_feature: HIJSMM301CE6DU.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcacat

SEQ ID NO: 575542 - DNA, 496 bp, Homo sapiens; identical to SEQ ID NO: 537925
  misc_feature: HIJSMM301CGQTI.22.14.B03.1.454.light.4.raw

SEQ ID NO: 575543 - DNA, 486 bp, Homo sapiens
  misc_feature: HIJSMM301DEJ32.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccatccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccat

SEQ ID NO: 575544 - DNA, 489 bp, Homo sapiens; identical to SEQ ID NO: 539323
  misc_feature: HIJSMM301BD9C5.49.46.E02.1.454.light.4.raw

SEQ ID NO: 575545 - DNA, 494 bp, Homo sapiens
  misc_feature: HIJSMM301C5P3Z.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatggttggggttttattactgcatgcaagctctacaaactccttactactttggccgagggaccaagctggagatacaaacgaactgt

SEQ ID NO: 575546 - DNA, 501 bp, Homo sapiens
  misc_feature: HIJSMM301EIBHA.17.29.C07.1.454.light.4.raw
cgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagtccaaggctgccccccg

SEQ ID NO: 575547 - DNA, 515 bp, Homo sapiens
  misc_feature: HIJSMM301DHFS2.17.28.C06.1.454.light.4.raw
cgtagactagcacgaccggtgctcgatttagagctcacgtattgggtttggggagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcacctctgttcccgccct

SEQ ID NO: 575548 - DNA, 502 bp, Homo sapiens
  misc_feature: HIJSMM301DOPCF.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaatgggaccacggtcaccgtcctaggtcagcccaaggccaacccccactgtcactt

SEQ ID NO: 575549 - DNA, 507 bp, Homo sapiens; identical to SEQ ID NO: 538702
  misc_feature: HIJSMM301C3O3S.11.57.F02.1.454.light.4.raw

SEQ ID NO: 575550 - DNA, 494 bp, Homo sapiens; identical to SEQ ID NO: 534992
  misc_feature: HIJSMM301AEOV2.9.1.A01.1.454.light.4.raw

SEQ ID NO: 575551 - DNA, 503 bp, Homo sapiens
  misc_feature: HIJSMM301CBEGB.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcccgtgggaccaaagtggagatcaaacgaactgtggctgcacca

SEQ ID NO: 575552 - DNA, 490 bp, Homo sapiens; identical to SEQ ID NO: 536909
  misc_feature: HIJSMM301DCSOR.12.27.C05.1.454.light.4.raw

SEQ ID NO: 575553 - DNA, 522 bp, Homo sapiens
  misc_feature: HIJSMM301EVY8Y.15.34.D01.1.454.light.4.raw
tctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccc

SEQ ID NO: 575554 - DNA, 457 bp, Homo sapiens
  misc_feature: HIJSMM301D0KOG.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtggctgcaccatctgtcttcatcttcccgccatctgatcgtagcact

SEQ ID NO: 575555 - DNA, 511 bp, Homo sapiens
  misc_feature: HIJSMM301DJCFQ.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctgttccca

SEQ ID NO: 575556 - DNA, 491 bp, Homo sapiens; identical to SEQ ID NO: 536211
  misc_feature: HIJSMM301C8ZR8.16.53.E09.1.454.light.4.raw

SEQ ID NO: 575557 - DNA, 490 bp, Homo sapiens
  misc_feature: HIJSMM301E0QM6.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatacaaacgaactagtggctgcaccatctgtt

SEQ ID NO: 575558 - DNA, 486 bp, Homo sapiens
  misc_feature: HIJSMM301BOG7W.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccgaagctgaccgtcctaggtcagaccccg

SEQ ID NO: 575559 - DNA, 497 bp, Homo sapiens; identical to SEQ ID NO: 538061
  misc_feature: HIJSMM301CNGUF.16.46.E02.1.454.light.4.raw

SEQ ID NO: 575560 - DNA, 464 bp, Homo sapiens
  misc_feature: HIJSMM301EADZY.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagaccaaccccactgtcactctgttcccaccctcctccatactcgta

SEQ ID NO: 575561 - DNA, 494 bp, Homo sapiens
  misc_feature: HIJSMM301CCO74.9.71.G05.1.454.light.4.raw
tgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctg

SEQ ID NO: 575562 - DNA, 505 bp, Homo sapiens; identical to SEQ ID NO: 549187
  misc_feature: HIJSMM301BW86N.12.53.E09.1.454.light.4.raw

SEQ ID NO: 575563 - DNA, 509 bp, Homo sapiens; identical to SEQ ID NO: 539359
  misc_feature: HIJSMM301DGUFP.47.85.H08.1.454.light.4.raw

SEQ ID NO: 575564 - DNA, 489 bp, Homo sapiens
  misc_feature: HIJSMM301AIRKD.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccgaggggaccaagctggagatcaaacgaactagtggctgcaccat

SEQ ID NO: 575565 - DNA, 482 bp, Homo sapiens
  misc_feature: HIJSMM301BKTYI.8.4.A04.1.454.light.4.raw
ctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactcccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaccaagctgaccgtcctaggtcagcccc

SEQ ID NO: 575566 - DNA, 445 bp, Homo sapiens; identical to SEQ ID NO: 537719
  misc_feature: HIJSMM301A87PL.47.85.H08.1.454.light.4.raw

SEQ ID NO: 575567 - DNA, 489 bp, Homo sapiens
  misc_feature: HIJSMM301B48HK.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtgggtcccatcaaggttcagcggcagtggatctgggacagatttcactctcactatcagcagcctgcagcctgaagattttggaactttattattgtcaacagggtaacagtttcccgctcaccttcggcggagggaccaaggtggagatgaaaagaactgtggctgcaccat

SEQ ID NO: 575568 - DNA, 486 bp, Homo sapiens; identical to SEQ ID NO: 535043
  misc_feature: HIJSMM301ALUTV.46.35.D02.1.454.light.4.raw

SEQ ID NO: 575569 - DNA, 499 bp, Homo sapiens
  misc_feature: HIJSMM301AOERX.3.35.D02.1.454.light.4.raw
agacgcactccacgaccggtgctcgatttagcacacgatagttgggtttggggtgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggagggctgaggatgttgggatttatttctgcatgcaagctacacactggccgtacacttttggccaggggaccaagctggagatcaaacgaactgtggctgcacca

SEQ ID NO: 575570 - DNA, 496 bp, Homo sapiens; identical to SEQ ID NO: 538149
  misc_feature: HIJSMM301CZAX1.13.67.G01.1.454.light.4.raw

SEQ ID NO: 575571 - DNA, 502 bp, Homo sapiens
  misc_feature: HIJSMM301BEREV.12.67.G01.1.454.light.4.raw
atacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaaccca

SEQ ID NO: 575572 - DNA, 484 bp, Homo sapiens
  misc_feature: HIJSMM301BBRCN.48.85.H08.1.454.light.4.raw
agtatacatacacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattaactggactccaacctgaggacgaggctgactattattgctcagcatgggacaccagcctcaatgccgcggtattcggcgcagggaccaagctgaccgtcctaggtcacg

SEQ ID NO: 575573 - DNA, 505 bp, Homo sapiens; identical to SEQ ID NO: 535503
  misc_feature: HIJSMM301BES09.8.28.C06.1.454.light.4.raw

SEQ ID NO: 575574 - DNA, 441 bp, Homo sapiens; identical to SEQ ID NO: 534971
  misc_feature: HIJSMM301AHQDF.11.3.A03.1.454.light.4.raw

SEQ ID NO: 575575 - DNA, 495 bp, Homo sapiens
  misc_feature: HIJSMM301AL36V.48.76.G10.1.454.light.4.raw
agtatacatacacgaccggtgctcgatttagtcactcatacaggggagtcagacccagtcaggacacagcatggacatgagggtccccgctcagctcctggggctcctgctgctctggctcccaggtgccaaatgtgacatccagatgacccagtttccttccaccctgtctacatttgtgggagacagagtcagtatcagttgccgggccagtcagagtattactaggtggttggcctggtatcagcagagaccagggaaagcccctaagctcctaatccaagaggcatccaccttagaagttggggtcccgtcacggttcagcggcagcgggtctgggacagcgttcactctcaccatcagcggcctgcagtctgatgattttgcaacttattactgccaacagtatagtacttatccgtacacttttggccaggggaccaagctggagatcaaacgaactgtggctgcaccatctgtcttcatcttcccgcc

SEQ ID NO: 575576 - DNA, 489 bp, Homo sapiens; identical to SEQ ID NO: 536663
  misc_feature: HIJSMM301APPVX.16.72.G06.1.454.light.4.raw

SEQ ID NO: 575577 - DNA, 476 bp, Homo sapiens; identical to SEQ ID NO: 536632
  misc_feature: HIJSMM301CW1GT.52.1.A01.1.454.light.4.raw

SEQ ID NO: 575578 - DNA, 523 bp, Homo sapiens
  misc_feature: HIJSMM301EBDAY.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattatgtagttcatatacaaccagtgacacttgggtgttcggcggagggaccaggctgaccgtcctaggtcagcccaaggctcgccccctcggtcactctcgttcccaccct

SEQ ID NO: 575579 - DNA, 492 bp, Homo sapiens
  misc_feature: HIJSMM301AS6VK.26.78.H01.1.454.light.4.raw
agactatactcacgaccggtgctcgatttagtgtgagtagtttgggtttgggggagggaactgctcagttaggacccagagggaaccatggaagccccagctcagcttctcttcctcctgctactctggctcccagattccaccgggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgt

SEQ ID NO: 575580 - DNA, 489 bp, Homo sapiens
  misc_feature: HIJSMM301DXBHZ.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcggtctgggacagatttcactctcaccatcagcagcctgcaggctgaagatgtggcagtttattactgtcagcaatattctactactcctcggactttcggcggagggaccgaaggtggagatacaaacgaact

SEQ ID NO: 575581 - DNA, 454 bp, Homo sapiens; identical to SEQ ID NO: 534964
  misc_feature: HIJSMM301DL3ZA.19.86.H09.1.454.light.4.raw

SEQ ID NO: 575582 - DNA, 504 bp, Homo sapiens; identical to SEQ ID NO: 542288
  misc_feature: HIJSMM301CL0IT.8.28.C06.1.454.light.4.raw

SEQ ID NO: 575583 - DNA, 493 bp, Homo sapiens; identical to SEQ ID NO: 535657
  misc_feature: HIJSMM301EB6FQ.27.78.H01.1.454.light.4.raw

SEQ ID NO: 575584 - DNA, 487 bp, Homo sapiens
  misc_feature: HIJSMM301AYDQD.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggcctcccaggctcctcatctatggtgcatctaccagggccactggtatcccagccaggttcagtggcagtgggtctgggacagagttcactctcaccatcagcagcctgcagtctgaagattttgctagtttattactgtcaacagtataatgactggtggacgttcggccaagggaccaaggtggagaccaaacgaactgtggctgcaccat

SEQ ID NO: 575585 - DNA, 375 bp, Homo sapiens; identical to SEQ ID NO: 537938
  misc_feature: HIJSMM301BZVOQ.9.11.A11.1.454.light.4.raw

SEQ ID NO: 575586 - DNA, 498 bp, Homo sapiens
  misc_feature: HIJSMM301CNYP3.15.83.H06.1.454.light.4.raw
  modified_base (486)..(486): a, c, t, g, unknown or other
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcggtccaagggaccaaggtaggacgagtcaaacgaacctagtggctgcnccaatctgtctt

SEQ ID NO: 575587 - DNA, 509 bp, Homo sapiens
  misc_feature: HIJSMM301DT8DN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcgtccgaacgggaccgaaggtaggaaatacaaacgaaactgtggctgcaccatctgtcttcatcttccccg

SEQ ID NO: 575588 - DNA, 510 bp, Homo sapiens
  misc_feature: HIJSMM301BXEE0.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaagtcagcccaaggctgccccctcggtcactctgttcccg

SEQ ID NO: 575589 - DNA, 500 bp, Homo sapiens
  misc_feature: HIJSMM301AWF9P.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatacaggccgggacccgaggctagtggatggaggctgactattactgtcgaggcggtgggacagcagcactcgcccgctatcgttcgttccggaacgtcgggaaccgtaacggtccacccgtacctaacgtcacgaccccg

SEQ ID NO: 575590 - DNA, 497 bp, Homo sapiens
  misc_feature: HIJSMM301B43O5.52.78.H01.1.454.light.4.raw
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctggt

SEQ ID NO: 575591 - DNA, 504 bp, Homo sapiens; identical to SEQ ID NO: 538940
  misc_feature: HIJSMM301BGG2F.2.35.D02.1.454.light.4.raw

SEQ ID NO: 575592 - DNA, 518 bp, Homo sapiens; identical to SEQ ID NO: 562129
  misc_feature: HIJSMM301DQU37.5.27.C05.1.454.light.4.raw

SEQ ID NO: 575593 - DNA, 508 bp, Homo sapiens; identical to SEQ ID NO: 541908
  misc_feature: HIJSMM301C1LKW.47.85.H08.1.454.light.4.raw

SEQ ID NO: 575594 - DNA, 490 bp, Homo sapiens; identical to SEQ ID NO: 535526
  misc_feature: HIJSMM301CEQYX.26.78.H01.1.454.light.4.raw

SEQ ID NO: 575595 - DNA, 486 bp, Homo sapiens
  misc_feature: HIJSMM301B8JZM.48.22.B11.1.454.light.4.raw
agtatacatacacgaccggtgctcgatttagacgacagctcagggggagtcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggcctaggggaccaaggtggagatcaaacgaactgtggctgcaccatctgtt

SEQ ID NO: 575596 - DNA, 504 bp, Homo sapiens
  misc_feature: HIJSMM301EP1BT.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggaggggaccaaggtagagatacaaaggaactgtggctgcaccatctgtcttcatcttcccgccta

SEQ ID NO: 575597 - DNA, 444 bp, Homo sapiens; identical to SEQ ID NO: 534993
  misc_feature: HIJSMM301CZYK7.5.9.A09.1.454.light.4.raw

SEQ ID NO: 575598 - DNA, 516 bp, Homo sapiens
  misc_feature: HIJSMM301AYCYW.43.81.H04.1.454.light.4.raw
tgtgagtagtcacgaccggtgctcgatttagtagtgtagattcgcgggcacgaccggtgctcgatttagtagtgtagattcgcgggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttggggcaaagctgccctgacactgtcaggtgtgcaccctgaggacgaggctgagtattactgtctgctccactttcgtactgcctgggtcttcggcggggggactcagttgaccgtcctaggtcacgcccaac

SEQ ID NO: 575599 - DNA, 493 bp, Homo sapiens
  misc_feature: HIJSMM301CC33Y.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcactttcg

SEQ ID NO: 575600 - DNA, 492 bp, Homo sapiens; identical to SEQ ID NO: 538317
  misc_feature: HIJSMM301A4AVR.10.17.B06.1.454.light.4.raw

SEQ ID NO: 575601 - DNA, 491 bp, Homo sapiens
  misc_feature: HIJSMM301D17S8.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcacctttcggcggagggaccaaggcggagatcagacgaactgtggctgcaccatctgtcttcta

SEQ ID NO: 575602 - DNA, 495 bp, Homo sapiens; identical to SEQ ID NO: 541828
  misc_feature: HIJSMM301AG8SF.19.71.G05.1.454.light.4.raw

SEQ ID NO: 575603 - DNA, 488 bp, Homo sapiens
  misc_feature: HIJSMM301B8NQ0.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaaggctggagatcaaacgaa

SEQ ID NO: 575604 - DNA, 485 bp, Homo sapiens; identical to SEQ ID NO: 535606
  misc_feature: HIJSMM301DBOMO.47.46.E02.1.454.light.4.raw

SEQ ID NO: 575605 - DNA, 509 bp, Homo sapiens; identical to SEQ ID NO: 537131
  misc_feature: HIJSMM301ECIRB.17.33.C11.1.454.light.4.raw

SEQ ID NO: 575606 - DNA, 454 bp, Homo sapiens; identical to SEQ ID NO: 535005
  misc_feature: HIJSMM301BU4LK.19.86.H09.1.454.light.4.raw

SEQ ID NO: 575607 - DNA, 516 bp, Homo sapiens; identical to SEQ ID NO: 535549
  misc_feature: HIJSMM301DQE4S.14.70.G04.1.454.light.4.raw

SEQ ID NO: 575608 - DNA, 463 bp, Homo sapiens; identical to SEQ ID NO: 535062
  misc_feature: HIJSMM301CP9MD.11.73.G07.1.454.light.4.raw

SEQ ID NO: 575609 - DNA, 492 bp, Homo sapiens
  misc_feature: HIJSMM301D42S0.4.24.C02.1.454.light.4.raw
agcactgtagcacgaccggtgctcgatttagtacagatcgttagggaaaggggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggccaagggaccaaggtggaaatcagacgaactgtggctgcaccatctgtcttcta

SEQ ID NO: 575610 - DNA, 495 bp, Homo sapiens
  misc_feature: HIJSMM301CSP4V.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaacgaactgtggctgcaccatctgt

SEQ ID NO: 575611 - DNA, 495 bp, Homo sapiens; identical to SEQ ID NO: 545183
  misc_feature: HIJSMM301APRK0.16.10.A10.1.454.light.4.raw

SEQ ID NO: 575612 - DNA, 480 bp, Homo sapiens; identical to SEQ ID NO: 535630
  misc_feature: HIJSMM301DGQ1B.40.59.F04.1.454.light.4.raw

SEQ ID NO: 575613 - DNA, 502 bp, Homo sapiens; identical to SEQ ID NO: 536253
  misc_feature: HIJSMM301BLZZU.21.22.B11.1.454.light.4.raw

SEQ ID NO: 575614 - DNA, 509 bp, Homo sapiens
  misc_feature: HIJSMM301AQW3G.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaacccactgtcactctgttcccacct

SEQ ID NO: 575615 - DNA, 445 bp, Homo sapiens
  misc_feature: HIJSMM301B6GFZ.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttccccaccctcctccactactatg

SEQ ID NO: 575616 - DNA, 492 bp, Homo sapiens
  misc_feature: HIJSMM301AHVKL.4.22.B11.1.454.light.4.raw
agcactgtagcacgaccggtgctcgatttagacgacagctcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaactagtggctgcaccat

SEQ ID NO: 575617 - DNA, 447 bp, Homo sapiens; identical to SEQ ID NO: 535020
  misc_feature: HIJSMM301BKUDR.18.9.A09.1.454.light.4.raw

SEQ ID NO: 575618 - DNA, 513 bp, Homo sapiens
  misc_feature: HIJSMM301AF8SY.51.39.D06.1.454.light.4.raw
cgatcgtatacacgaccggtgctcgatttagtgacatctcgcagttctttgggggtgggtccaggaggcagaactctgggtggtctcaccatggcctggatccctctacttctccccctccctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaaggtcagggacaacggtcacattggccatcagtggagtccaggcagaggacgaggctgactattattgtcaatcaacagacaccattggtcttaatgtcttcggtaaccgtgcgaccaaaggtacgacccgtccctcggggtcgagccccaacgggaccaacccccaaccct

SEQ ID NO: 575619 - DNA, 487 bp, Homo sapiens; identical to SEQ ID NO: 555321
  misc_feature: HIJSMM301A9IN8.19.71.G05.1.454.light.4.raw

SEQ ID NO: 575620 - DNA, 498 bp, Homo sapiens
  misc_feature: HIJSMM301BB9ER.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccggcagaggacgaggctgactattactgtcaatcaacagacagtagtggtacttatgtgcaggttggcggagggaccaagctgaccgtctaggtcagcccaaggcctgccccctcggtcacg

SEQ ID NO: 575621 - DNA, 493 bp, Homo sapiens
  misc_feature: HIJSMM301DDOJ6.4.59.F04.1.454.light.4.raw
agcactgtagcacgaccggtgctcgatttagtacacacacttagggattggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttatattgtcaccagtattatagttggcctccgtggacgttcggccaagggaccaaggtggaaatcaaacgaactgtggctgcaccatctgtct

SEQ ID NO: 575622 - DNA, 492 bp, Homo sapiens
  misc_feature: HIJSMM301BVG91.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggggtttattacttgcatgcaagctctacaaactccttacacttttggccagggaccaagctggagatcaaacgaactgt

SEQ ID NO: 575623 - DNA, 495 bp, Homo sapiens
  misc_feature: HIJSMM301AN4KC.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 575624 - DNA, 486 bp, Homo sapiens
  misc_feature: HIJSMM301CWXGT.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggcgtctattattgcatgcaagctctacaagtcccgctcacttcgtcggagggacgaacggtaggagatcaaacaaa

SEQ ID NO: 575625 - DNA, 491 bp, Homo sapiens; identical to SEQ ID NO: 535176
  misc_feature: HIJSMM301EJWAB.13.39.D06.1.454.light.4.raw

SEQ ID NO: 575626 - DNA, 443 bp, Homo sapiens
  misc_feature: HIJSMM301AUXBZ.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccacctcctctgtcgagcgt

SEQ ID NO: 575627 - DNA, 494 bp, Homo sapiens
  misc_feature: HIJSMM301DG3OU.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaacggtggaggatcaaacgaaccta

SEQ ID NO: 575628 - DNA, 505 bp, Homo sapiens
  misc_feature: HIJSMM301BYADF.40.16.B05.1.454.light.4.raw
tctagcgactcacgaccggtgctcgatttagagctcacgtaaggggggggtctcaggaggcagcactctcgggacgtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattatactgctgctcatttgcaggtagtttttgggtgttcggcggagggaccaagctgaccgtcctaggtcagcccaaggctgccccctggtcactctgttcccg

SEQ ID NO: 575629 - DNA, 474 bp, Homo sapiens; identical to SEQ ID NO: 551694
  misc_feature: HIJSMM301EH6IY.18.76.G10.1.454.light.4.raw

SEQ ID NO: 575630 - DNA, 487 bp, Homo sapiens; identical to SEQ ID NO: 536025
  misc_feature: HIJSMM301AV4A4.17.34.D01.1.454.light.4.raw

SEQ ID NO: 575631 - DNA, 491 bp, Homo sapiens; identical to SEQ ID NO: 537594
  misc_feature: HIJSMM301BR1GH.4.24.C02.1.454.light.4.raw

SEQ ID NO: 575632 - DNA, 489 bp, Homo sapiens; identical to SEQ ID NO: 558034
  misc_feature: HIJSMM301EMQDE.8.12.B01.1.454.light.4.raw

SEQ ID NO: 575633 - DNA, 492 bp, Homo sapiens
  misc_feature: HIJSMM301AZRYM.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggcccaaccccactgtcactctcgttcccaccctcctctacgtgagct

SEQ ID NO: 575634 - DNA, 515 bp, Homo sapiens
  misc_feature: HIJSMM301D11FR.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccgaagctgaccgtcctaggtcagcccaaggctgccccctcggtcactctgtcccaccctcctcagacgtatcac

SEQ ID NO: 575635 - DNA, 484 bp, Homo sapiens; identical to SEQ ID NO: 535400
  misc_feature: HIJSMM301E0SES.46.26.C04.1.454.light.4.raw

SEQ ID NO: 575636 - DNA, 495 bp, Homo sapiens
  misc_feature: HIJSMM301A5Z8D.13.9.A09.1.454.light.4.raw
tcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctcgttccca

SEQ ID NO: 575637 - DNA, 533 bp, Homo sapiens
  misc_feature: HIJSMM301AF7XD.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacggaccgaacggtacggaaggtacgaaacgaactagtggcgtcgacacactctcgttcttactactccttcccgtcctacctctcgt

SEQ ID NO: 575638 - DNA, 494 bp, Homo sapiens; identical to SEQ ID NO: 557531
  misc_feature: HIJSMM301B7WNR.11.59.F04.1.454.light.4.raw

SEQ ID NO: 575639 - DNA, 488 bp, Homo sapiens
  misc_feature: HIJSMM301CRKBD.46.35.D02.1.454.light.4.raw
actagcagtacacgaccggtgctcgatttagcacacgatagttggggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcacccatcagcagactggagcctgaagattttgcagtctattactgtcagcagtatggtcacgtcccaagaacttttggccaggggaccaagctggagatcaaacgaactgtggctgcaccat

SEQ ID NO: 575640 - DNA, 499 bp, Homo sapiens; identical to SEQ ID NO: 536578
  misc_feature: HIJSMM301DS6I9.22.27.C05.1.454.light.4.raw

SEQ ID NO: 575641 - DNA, 514 bp, Homo sapiens; identical to SEQ ID NO: 546238
  misc_feature: HIJSMM301A8R1X.47.85.H08.1.454.light.4.raw

SEQ ID NO: 575642 - DNA, 524 bp, Homo sapiens
  misc_feature: HIJSMM301AOH3E.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccacctcgtcactctgttcccgccctcctcccgtcgtc

SEQ ID NO: 575643 - DNA, 488 bp, Homo sapiens; identical to SEQ ID NO: 537329
  misc_feature: HIJSMM301CSTL6.26.23.C01.1.454.light.4.raw

SEQ ID NO: 575644 - DNA, 500 bp, Homo sapiens; identical to SEQ ID NO: 540219
  misc_feature: HIJSMM301ATMYW.43.34.D01.1.454.light.4.raw

SEQ ID NO: 575645 - DNA, 508 bp, Homo sapiens
  misc_feature: HIJSMM301ARBZ5.52.77.G11.1.454.light.4.raw
cgcagtacgacacgaccggtgctcgatttagctagtcactcaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtca

SEQ ID NO: 575646 - DNA, 447 bp, Homo sapiens; identical to SEQ ID NO: 535201
  misc_feature: HIJSMM301CHOF5.18.9.A09.1.454.light.4.raw

SEQ ID NO: 575647 - DNA, 498 bp, Homo sapiens
  misc_feature: HIJSMM301EOO9B.43.71.G05.1.454.light.4.raw
tgtgagtagtcacgaccggtgctcgatttagtgtcgtcgcaagagagaggggggaagagctgctcagttaggacccagagggaaccatggaaaccccagcgcagcttctcttcctcctgctactctggctcccagatgccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 575648 - DNA, 485 bp, Homo sapiens; identical to SEQ ID NO: 539576
  misc_feature: HIJSMM301CI7ZG.4.57.F02.1.454.light.4.raw

SEQ ID NO: 575649 - DNA, 500 bp, Homo sapiens; identical to SEQ ID NO: 541228
  misc_feature: HIJSMM301DOEY2.13.11.A11.1.454.light.4.raw

SEQ ID NO: 575650 - DNA, 491 bp, Homo sapiens
  misc_feature: HIJSMM301D8DWW.5.47.E03.1.454.light.4.raw
atcagacacgcacgaccggtgctcgatttagactcgcgcacagagagaagggggaagagctgctcagttaggacccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggcatcccacgtaggttcagtggcagtgggtctgggacagacttcactctcaccatcagcagactggagcctgaagattttgcagtgtattactgtcagcagtatgggctctcaccttttcacttttcggcggagggaccaaggtggagaacaaacgaactgtggctgcaccat

SEQ ID NO: 575651 - DNA, 491 bp, Homo sapiens
  misc_feature: HIJSMM301E16S2.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctactacttttggccaggggaccaagctggagatcaaacgaactgtgg

SEQ ID NO: 575652 - DNA, 524 bp, Homo sapiens
  misc_feature: HIJSMM301DY173.49.40.D07.1.454.light.4.raw
agtcgagagacacgaccggtgctcgatttagtgatagagcgtaacaacagaggggagcctgggcctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtcatattcggcggagggaccaaattgaccgtcctgggtcagcccaaggctgccccctcggtcactctgttcccaccctcctctctctcg

SEQ ID NO: 575653 - DNA, 471 bp, Homo sapiens
  misc_feature: HIJSMM301BKHPZ.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacagggtcccaccaaggttcagcggaagtggatctgggacagattttaatttcaccatcagcagcctccaacgtgatgatgttgcaacatactattgtcagcaatatgattttgctcctccgtagtgccacttttggcgggggaccaaggtggacatcaaacgaa

SEQ ID NO: 575654 - DNA, 478 bp, Homo sapiens; identical to SEQ ID NO: 539087
  misc_feature: HIJSMM301AZC14.48.5.A05.1.454.light.4.raw

SEQ ID NO: 575655 - DNA, 494 bp, Homo sapiens; identical to SEQ ID NO: 534994
  misc_feature: HIJSMM301BQ6O5.27.78.H01.1.454.light.4.raw

SEQ ID NO: 575656 - DNA, 470 bp, Homo sapiens; identical to SEQ ID NO: 535302
  misc_feature: HIJSMM301DR83Y.13.76.G10.1.454.light.4.raw

SEQ ID NO: 575657 - DNA, 482 bp, Homo sapiens
  misc_feature: HIJSMM301CMKWJ.47.62.F07.1.454.light.4.raw
agctcacgtacacgaccggtgctcgatttagtagtcgcataaagggaaagggggagtcagtcccaatcaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaaactgtggctgcaccat

SEQ ID NO: 575658 - DNA, 503 bp, Homo sapiens; identical to SEQ ID NO: 573497
  misc_feature: HIJSMM301E0LYN.48.26.C04.1.454.light.4.raw

SEQ ID NO: 575659 - DNA, 419 bp, Homo sapiens
  misc_feature: HIJSMM301C3B8N.41.53.E09.1.454.light.4.raw
tctatactatcacgaccggtgctcgatttagagagagtgtgttgggtttgggggctttgtctgggtctcctggacagtcgatcaccatctcctgcactggaaccagcagtgacgttggtggttataactatgtctcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatatacaagcagcagcactctcgtggtattcggcggagggaccaagctgaccgtcctaggtcagcccaaggctgccccctcggtcactctgttcccgccctcctcatagtataga

SEQ ID NO: 575660 - DNA, 497 bp, Homo sapiens; identical to SEQ ID NO: 535664
  misc_feature: HIJSMM301B67QM.22.14.B03.1.454.light.4.raw

SEQ ID NO: 575661 - DNA, 454 bp, Homo sapiens; identical to SEQ ID NO: 535005
  misc_feature: HIJSMM301CWZ9D.19.86.H09.1.454.light.4.raw

SEQ ID NO: 575662 - DNA, 477 bp, Homo sapiens; identical to SEQ ID NO: 541452
  misc_feature: HIJSMM301DA41Z.21.25.C03.1.454.light.4.raw

SEQ ID NO: 575663 - DNA, 496 bp, Homo sapiens; identical to SEQ ID NO: 541857
  misc_feature: HIJSMM301DFL91.3.31.C09.1.454.light.4.raw

SEQ ID NO: 575664 - DNA, 494 bp, Homo sapiens
  misc_feature: HIJSMM301A1KHQ.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggcctgccccctggtcactctgttcccgccctcctcacgcg

SEQ ID NO: 575665 - DNA, 446 bp, Homo sapiens; identical to SEQ ID NO: 536034
  misc_feature: HIJSMM301CWAQF.18.9.A09.1.454.light.4.raw

SEQ ID NO: 575666 - DNA, 484 bp, Homo sapiens
  misc_feature: HIJSMM301ATIO8.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaacggtggaaatacaaacgaactagtggcgtgcacca

SEQ ID NO: 575667 - DNA, 495 bp, Homo sapiens; identical to SEQ ID NO: 536055
  misc_feature: HIJSMM301C58S8.47.38.D05.1.454.light.4.raw

SEQ ID NO: 575668 - DNA, 384 bp, Homo sapiens; identical to SEQ ID NO: 555393
  misc_feature: HIJSMM301DDSH9.48.87.H10.1.454.light.4.raw

SEQ ID NO: 575669 - DNA, 497 bp, Homo sapiens; identical to SEQ ID NO: 545974
  misc_feature: HIJSMM301DMF5A.15.25.C03.1.454.light.4.raw

SEQ ID NO: 575670 - DNA, 505 bp, Homo sapiens; identical to SEQ ID NO: 535503
  misc_feature: HIJSMM301A3ZZS.8.28.C06.1.454.light.4.raw

SEQ ID NO: 575671 - DNA, 494 bp, Homo sapiens; identical to SEQ ID NO: 549057
  misc_feature: HIJSMM301C2LDH.10.33.C11.1.454.light.4.raw

SEQ ID NO: 575672 - DNA, 494 bp, Homo sapiens
  misc_feature: HIJSMM301AZC25.49.24.C02.1.454.light.4.raw
agtcgagagacacgaccggtgctcgatttagtacagatcgttagggaaagggggagtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcta

SEQ ID NO: 575673 - DNA, 476 bp, Homo sapiens
  misc_feature: HIJSMM301BMX14.52.9.A09.1.454.light.4.raw
cgcagtacgacacgaccggtgctcgatttagcgagacgcgcagggtgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggccaggggaccaagctggagatcaaacgaa

SEQ ID NO: 575674 - DNA, 440 bp, Homo sapiens
  misc_feature: HIJSMM301D6XHU.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccacctcctcatagtataga

SEQ ID NO: 575675 - DNA, 481 bp, Homo sapiens; identical to SEQ ID NO: 535993
  misc_feature: HIJSMM301A0S17.21.25.C03.1.454.light.4.raw

SEQ ID NO: 575676 - DNA, 488 bp, Homo sapiens
  misc_feature: HIJSMM301A9MBJ.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacgggaccgacggtggatgtcaagcgaactgtggctgcaccta

SEQ ID NO: 575677 - DNA, 491 bp, Homo sapiens
  misc_feature: HIJSMM301A2M0U.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggtcgtgttcggtcggcgggaccgaacgcg

SEQ ID NO: 575678 - DNA, 503 bp, Homo sapiens
  misc_feature: HIJSMM301D01T4.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgatttattactgtgcaggatgggatgacaacctgggtgcttatctcttcggacctgggaccaaggtcaccgtcttggt

SEQ ID NO: 575679 - DNA, 486 bp, Homo sapiens; identical to SEQ ID NO: 554850
  misc_feature: HIJSMM301ALBIU.41.72.G06.1.454.light.4.raw

SEQ ID NO: 575680 - DNA, 485 bp, Homo sapiens; identical to SEQ ID NO: 535688
  misc_feature: HIJSMM301DEIKX.19.5.A05.1.454.light.4.raw

SEQ ID NO: 575681 - DNA, 485 bp, Homo sapiens; identical to SEQ ID NO: 534977
  misc_feature: HIJSMM301DSH1X.15.28.C06.1.454.light.4.raw

SEQ ID NO: 575682 - DNA, 494 bp, Homo sapiens; identical to SEQ ID NO: 534994
  misc_feature: HIJSMM301AG3F8.27.78.H01.1.454.light.4.raw

SEQ ID NO: 575683 - DNA, 506 bp, Homo sapiens; identical to SEQ ID NO: 534969
  misc_feature: HIJSMM301AH0ZF.18.37.D04.1.454.light.4.raw

SEQ ID NO: 575684 - DNA, 512 bp, Homo sapiens
  misc_feature: HIJSMM301ELLNT.14.78.H01.1.454.light.4.raw
cgtctagtaccacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctggtccactctgtt

SEQ ID NO: 575685 - DNA, 493 bp, Homo sapiens
  misc_feature: HIJSMM301A1WAT.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtctaggtcagccaaggccaacccactgcactctcgttcccaccctcctcgagtagtaca

SEQ ID NO: 575686 - DNA, 505 bp, Homo sapiens; identical to SEQ ID NO: 536117
  misc_feature: HIJSMM301C73YO.8.71.G05.1.454.light.4.raw

SEQ ID NO: 575687 - DNA, 498 bp, Homo sapiens
  misc_feature: HIJSMM301CDKDW.22.9.A09.1.454.light.4.raw
  modified_base (484)..(484): a, c, t, g, unknown or other
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtnttccatcttccccg

SEQ ID NO: 575688 - DNA, 526 bp, Homo sapiens
  misc_feature: HIJSMM301C6SFT.49.10.A10.1.454.light.4.raw
agtcgagagacacgaccggtgctcgatttagcgtcgatctcaggggctgggcctaaggaagcagcactggtggtgcctcagccatggcctggaccgttctcctcctcggcctcctctctcactgcacagaatctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcgaggtgtgggatagtgatacggaccagttgggtgttcgggcggagggaccaagggtgaccgtcctaggtcaggcccaaggctcgccccctcggtcactctcgttcccgccctcctctctctccg

SEQ ID NO: 575689 - DNA, 484 bp, Homo sapiens
  misc_feature: HIJSMM301EHRLR.51.64.F09.1.454.light.4.raw
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgcagtttattactgttcagcagtatgataagtggcctccgtacacttttggcctaggggaccaggctggagatcaaacgaactgtggctgcaccat

SEQ ID NO: 575690 - DNA, 504 bp, Homo sapiens
  misc_feature: HIJSMM301DUGXR.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgcccctcggt

SEQ ID NO: 575691 - DNA, 503 bp, Homo sapiens; identical to SEQ ID NO: 548067
  misc_feature: HIJSMM301AVZ3B.9.53.E09.1.454.light.4.raw

SEQ ID NO: 575692 - DNA, 487 bp, Homo sapiens; identical to SEQ ID NO: 536206
  misc_feature: HIJSMM301AH1CO.47.38.D05.1.454.light.4.raw

SEQ ID NO: 575693 - DNA, 495 bp, Homo sapiens
  misc_feature: HIJSMM301AELIJ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatccttccccg

SEQ ID NO: 575694 - DNA, 486 bp, Homo sapiens
  misc_feature: HIJSMM301A554J.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggaggatcaaacgaactgtggctgcacca

SEQ ID NO: 575695 - DNA, 494 bp, Homo sapiens; identical to SEQ ID NO: 534992
  misc_feature: HIJSMM301EQQPX.9.1.A01.1.454.light.4.raw

SEQ ID NO: 575696 - DNA, 498 bp, Homo sapiens
  misc_feature: HIJSMM301D5KF8.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagttttaccctcacaactcatatcacagaatctgaggatgctgcattttacttcggtctacaacatgataatttccctccgtggacgttcggccaagggaccaaggagcaaaatcaaacgaactgtggctagcaccatctgtcttcatcttcccgccat

SEQ ID NO: 575697 - DNA, 484 bp, Homo sapiens; identical to SEQ ID NO: 545944
  misc_feature: HIJSMM301A9RJB.46.35.D02.1.454.light.4.raw

SEQ ID NO: 575698 - DNA, 486 bp, Homo sapiens; identical to SEQ ID NO: 535523
  misc_feature: HIJSMM301BIMOQ.22.73.G07.1.454.light.4.raw

SEQ ID NO: 575699 - DNA, 473 bp, Homo sapiens; identical to SEQ ID NO: 538060
  misc_feature: HIJSMM301A1A7J.18.76.G10.1.454.light.4.raw

SEQ ID NO: 575700 - DNA, 521 bp, Homo sapiens; identical to SEQ ID NO: 539470
  misc_feature: HIJSMM301DRYKS.27.23.C01.1.454.light.4.raw

SEQ ID NO: 575701 - DNA, 499 bp, Homo sapiens
  misc_feature: HIJSMM301AR42N.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtgggtcccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactagtggctgcaccatctgtcttcatcttccccg

SEQ ID NO: 575702 - DNA, 483 bp, Homo sapiens
  misc_feature: HIJSMM301D2LU0.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaactgtgctgcacatctgt

SEQ ID NO: 575703 - DNA, 485 bp, Homo sapiens; identical to SEQ ID NO: 535985
  misc_feature: HIJSMM301DK7FN.15.1.A01.1.454.light.4.raw

SEQ ID NO: 575704 - DNA, 492 bp, Homo sapiens; identical to SEQ ID NO: 536010
  misc_feature: HIJSMM301BY2Q3.10.20.B09.1.454.light.4.raw

SEQ ID NO: 575705 - DNA, 485 bp, Homo sapiens; identical to SEQ ID NO: 535985
  misc_feature: HIJSMM301BNABK.15.1.A01.1.454.light.4.raw

SEQ ID NO: 575706 - DNA, 494 bp, Homo sapiens; identical to SEQ ID NO: 534994
  misc_feature: HIJSMM301AGQWP.27.78.H01.1.454.light.4.raw

SEQ ID NO: 575707 - DNA, 494 bp, Homo sapiens; identical to SEQ ID NO: 534994
  misc_feature: HIJSMM301DVSJ0.27.78.H01.1.454.light.4.raw

SEQ ID NO: 575708 - DNA, 487 bp, Homo sapiens; identical to SEQ ID NO: 557055
  misc_feature: HIJSMM301DHYEM.17.34.D01.1.454.light.4.raw

SEQ ID NO: 575709 - DNA, 510 bp, Homo sapiens
  misc_feature: HIJSMM301C4SHZ.9.37.D04.1.454.light.4.raw
tgatacgtctcacgaccggtgctcgatttagtagcatactgttgggtttgggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtgtgggggatacaacattggaagtaaaagtgttcactggtaccagcagaagccaggccaggcccctgtgttggtcgtctatgatgatacagaccggccctcagggatccctgagcgattctctggctccaattctggtgacacggccaccctgatcatcagcagggtcgaggtcgaggatgaggccgactattactgtcaggtgtgggatagtggtactgatcattgggtgttcggcggagggaccaagctgaccgtcctaggtcagcccaaggctgccccctcggtcactctgttcccgccctcctcagacgtatca

SEQ ID NO: 575710 - DNA, 489 bp, Homo sapiens; identical to SEQ ID NO: 535139
  misc_feature: HIJSMM301DY7SX.14.55.E11.1.454.light.4.raw

SEQ ID NO: 575711 - DNA, 482 bp, Homo sapiens; identical to SEQ ID NO: 535216
  misc_feature: HIJSMM301BKXN2.17.26.C04.1.454.light.4.raw

SEQ ID NO: 575712 - DNA, 499 bp, Homo sapiens
  misc_feature: HIJSMM301ESQN4.52.33.C11.1.454.light.4.raw
cgcagtacgacacgaccggtgctcgatttagagtgagctcgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcat

SEQ ID NO: 575713 - DNA, 493 bp, Homo sapiens
  misc_feature: HIJSMM301CYGRI.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaagtggagatcaaacgaactgtggctgcaccatctgtctt

SEQ ID NO: 575714 - DNA, 419 bp, Homo sapiens
  misc_feature: HIJSMM301ES5H2.9.34.D01.1.454.light.4.raw
tgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccgccctcccagacgtatca

SEQ ID NO: 575715 - DNA, 489 bp, Homo sapiens; identical to SEQ ID NO: 559947
  misc_feature: HIJSMM301BDOBN.5.23.C01.1.454.light.4.raw

SEQ ID NO: 575716 - DNA, 489 bp, Homo sapiens; identical to SEQ ID NO: 536013
  misc_feature: HIJSMM301BIPVV.26.23.C01.1.454.light.4.raw

SEQ ID NO: 575717 - DNA, 496 bp, Homo sapiens
  misc_feature: HIJSMM301ARO4A.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggcccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtaggagatcaaacgaactagtggctgcaccatctgtctt

SEQ ID NO: 575718 - DNA, 480 bp, Homo sapiens
  misc_feature: HIJSMM301EKGJF.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcaccatctgt

SEQ ID NO: 575719 - DNA, 480 bp, Homo sapiens; identical to SEQ ID NO: 535975
  misc_feature: HIJSMM301B3F1Z.51.60.F05.1.454.light.4.raw

SEQ ID NO: 575720 - DNA, 501 bp, Homo sapiens; identical to SEQ ID NO: 536867
  misc_feature: HIJSMM301DJ623.5.86.H09.1.454.light.4.raw

SEQ ID NO: 575721 - DNA, 505 bp, Homo sapiens
  misc_feature: HIJSMM301EOI9P.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccaggctgaccgtcctgagtcagcccaaggctgccccctc

SEQ ID NO: 575722 - DNA, 487 bp, Homo sapiens
  misc_feature: HIJSMM301DDTO2.11.76.G10.1.454.light.4.raw
cgagagataccacgaccggtgctcgatttagtcactcatacaggggacgaacaggcaggcaggggcagcaagatggtgttgcagacccaggtcttcatttctctgttgcgtctggatctctggtgcctgcggagacatcgtggatgacccagtctccagattccctggctgtgtcctctgggcgacgacggccaccatcaactgcaagtccagtcagaatctttagactattccactaagagagatttgttagtttggtacctaacagaagccaggccagcctccaaagcagctcatttattgggcatctactcggggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaactgt

SEQ ID NO: 575723 - DNA, 487 bp, Homo sapiens
  misc_feature: HIJSMM301B1X9S.21.4.A04.1.454.light.4.raw
tcgtcgctcgcacgaccggtgctcgatttagagtagtgatcaggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccat

SEQ ID NO: 575724 - DNA, 524 bp, Homo sapiens
  misc_feature: HIJSMM301C8580.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcacgtctcgttcccaccctt

SEQ ID NO: 575725 - DNA, 510 bp, Homo sapiens
  misc_feature: HIJSMM301AWXC6.8.42.D09.1.454.light.4.raw
ctcgcgtgtccacgaccggtgctcgatttagacacatacgcagggaaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgtaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgtttccaccct

SEQ ID NO: 575726 - DNA, 513 bp, Homo sapiens
  misc_feature: HIJSMM301C8KIF.51.26.C04.1.454.light.4.raw
cgatcgtatacacgaccggtgctcgatttagtctagcgactttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctgtt

SEQ ID NO: 575727 - DNA, 506 bp, Homo sapiens; identical to SEQ ID NO: 569322
  misc_feature: HIJSMM301BU1KE.18.78.H01.1.454.light.4.raw

SEQ ID NO: 575728 - DNA, 491 bp, Homo sapiens
  misc_feature: HIJSMM301CYSQD.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagtagtctgcaacctgaagattttgcaacttactactgtcaacagagttacacgtacccccctcactttcggcggagggaccaaggcggagatcagacgaactgtggctgcaccatctgtcttcatt

SEQ ID NO: 575729 - DNA, 447 bp, Homo sapiens; identical to SEQ ID NO: 535201
  misc_feature: HIJSMM301CR8DD.18.9.A09.1.454.light.4.raw

SEQ ID NO: 575730 - DNA, 504 bp, Homo sapiens; identical to SEQ ID NO: 538940
  misc_feature: HIJSMM301ANHP7.2.35.D02.1.454.light.4.raw

SEQ ID NO: 575731 - DNA, 514 bp, Homo sapiens
  misc_feature: HIJSMM301CMYOU.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttgaagcagccgatccagcctgcggagcctgtggggcaggtcagcccaaggccaaccccactgtcactctcgttcccc

SEQ ID NO: 575732 - DNA, 506 bp, Homo sapiens; identical to SEQ ID NO: 553279
  misc_feature: HIJSMM301CUB3I.14.3.A03.1.454.light.4.raw

SEQ ID NO: 575733 - DNA, 499 bp, Homo sapiens; identical to SEQ ID NO: 537800
  misc_feature: HIJSMM301EGP40.22.38.D05.1.454.light.4.raw

SEQ ID NO: 575734 - DNA, 503 bp, Homo sapiens; identical to SEQ ID NO: 562291
  misc_feature: HIJSMM301B1RNZ.9.71.G05.1.454.light.4.raw

SEQ ID NO: 575735 - DNA, 444 bp, Homo sapiens
  misc_feature: HIJSMM301DYYA5.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttccccgccctcctcgtactagacg

SEQ ID NO: 575736 - DNA, 501 bp, Homo sapiens; identical to SEQ ID NO: 536867
  misc_feature: HIJSMM301D2RQ1.5.86.H09.1.454.light.4.raw

SEQ ID NO: 575737 - DNA, 505 bp, Homo sapiens
  misc_feature: HIJSMM301A7ZZ0.22.15.B04.1.454.light.4.raw
acatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctcgccccctcggtctacc

SEQ ID NO: 575738 - DNA, 493 bp, Homo sapiens
  misc_feature: HIJSMM301B5M18.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctacaggttcagtggcagtggatcaggcacagattttacactgaaaatcagcagagtggaggctgaggatgttggggtttattactgcatgcaagctctacaacctctgcggactttcggccctggaccgaaagtggagatcaaacgaactgtggctgcaccatctgtctt

SEQ ID NO: 575739 - DNA, 479 bp, Homo sapiens; identical to SEQ ID NO: 538734
  misc_feature: HIJSMM301B0J8R.8.53.E09.1.454.light.4.raw

SEQ ID NO: 575740 - DNA, 486 bp, Homo sapiens; identical to SEQ ID NO: 536261
  misc_feature: HIJSMM301BJEAG.26.55.E11.1.454.light.4.raw

SEQ ID NO: 575741 - DNA, 506 bp, Homo sapiens
  misc_feature: HIJSMM301AL5KA.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctaaagatgttgcagtttattactgtcaacatcgtaccgagtggcctccgggggccacttcggccctcgggaccaagtggatatcaaacgaactagtggctgcaccatctgtctt

SEQ ID NO: 575742 - DNA, 476 bp, Homo sapiens; identical to SEQ ID NO: 547708
  misc_feature: HIJSMM301AT3MB.12.1.A01.1.454.light.4.raw

SEQ ID NO: 575743 - DNA, 486 bp, Homo sapiens
  misc_feature: HIJSMM301DMLED.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctcgcccccaaccttcggccaggggacacgactggagattaaacgaactgtggctgcaccatctgt

SEQ ID NO: 575744 - DNA, 517 bp, Homo sapiens
  misc_feature: HIJSMM301CZ945.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggtgttcggcggagggaccaggctgaccgtcctaggtcagcccaaggctgcccctcggtcactctgttccgcct

SEQ ID NO: 575745 - DNA, 486 bp, Homo sapiens; identical to SEQ ID NO: 536323
  misc_feature: HIJSMM301B8TI2.10.2.A02.1.454.light.4.raw

SEQ ID NO: 575746 - DNA, 512 bp, Homo sapiens
  misc_feature: HIJSMM301CXTYV.17.33.C11.1.454.light.4.raw
cgtagactagcacgaccggtgctcgatttagagtgagctcgttgggtttgggggcgccaggggtcccttccaatatcagcaccatggcctggactcttctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 575747 - DNA, 502 bp, Homo sapiens
  misc_feature: HIJSMM301CL1HV.27.78.H01.1.454.light.4.raw
agcgtcgtctcacgaccggtgctcgatttagtgtgagtagtttgggtttgggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaactttatactgtcatcagagtactactttactcagtagatcacctcggtccaacgggaacacgactggagattaaacg

SEQ ID NO: 575748 - DNA, 502 bp, Homo sapiens
  misc_feature: HIJSMM301BOJCS.9.71.G05.1.454.light.4.raw
tgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccgccctcctcagacgtatcac

SEQ ID NO: 575749 - DNA, 497 bp, Homo sapiens; identical to SEQ ID NO: 535286
  misc_feature: HIJSMM301AZH9X.18.59.F04.1.454.light.4.raw

SEQ ID NO: 575750 - DNA, 486 bp, Homo sapiens
  misc_feature: HIJSMM301CNGZR.51.78.H01.1.454.light.4.raw
cgatcgtatacacgaccggtgctcgatttagtgtgagtagtttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacaggatttcactctcaccatcagcagtgtgcgacctgaagattttgctaacttactactgtcaacagagttacagtacccctcacgctcactttcggcggtagggaccaaggtggagatcaaacgaactgtggctgcaccta

SEQ ID NO: 575751 - DNA, 487 bp, Homo sapiens; identical to SEQ ID NO: 536206
  misc_feature: HIJSMM301ELL1A.47.38.D05.1.454.light.4.raw

SEQ ID NO: 575752 - DNA, 480 bp, Homo sapiens
  misc_feature: HIJSMM301AY43R.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggaggatcaaacgaactgtggctgcacc

SEQ ID NO: 575753 - DNA, 471 bp, Homo sapiens; identical to SEQ ID NO: 540579
  misc_feature: HIJSMM301C9WE1.3.82.H05.1.454.light.4.raw

SEQ ID NO: 575754 - DNA, 482 bp, Homo sapiens; identical to SEQ ID NO: 540521
  misc_feature: HIJSMM301BZBTU.21.25.C03.1.454.light.4.raw

SEQ ID NO: 575755 - DNA, 493 bp, Homo sapiens; identical to SEQ ID NO: 535657
  misc_feature: HIJSMM301D3THY.27.78.H01.1.454.light.4.raw

SEQ ID NO: 575756 - DNA, 508 bp, Homo sapiens
  misc_feature: HIJSMM301AYM1M.49.23.C01.1.454.light.4.raw
agtcgagagacacgaccggtgctcgatttagtacacgtgattagggattgtgggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccg

SEQ ID NO: 575757 - DNA, 499 bp, Homo sapiens
  misc_feature: HIJSMM301ED6LE.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccagactgaggacgaggctgattattattgctgctcatatgcaggtagttacacttatgtcttcggaattgggacgacggtcaccgtcctaggtcagcccaaggccaaccca

SEQ ID NO: 575758 - DNA, 521 bp, Homo sapiens; identical to SEQ ID NO: 538715
  misc_feature: HIJSMM301BE732.27.23.C01.1.454.light.4.raw

SEQ ID NO: 575759 - DNA, 506 bp, Homo sapiens
  misc_feature: HIJSMM301BUHZ8.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaaagatgtggcagtttattactgtcaacagttttctcggggcgttcggccaagggaccaaggtggaaatacaaacgaaactgtggctgcaccatctgtcttcatcttccccg

SEQ ID NO: 575760 - DNA, 464 bp, Homo sapiens
  misc_feature: HIJSMM301B6188.43.75.G09.1.454.light.4.raw
tgtgagtagtcacgaccggtgctcgatttagtatagacatcagggggaatcagacccagtcaggacacagcatggacatgagagtcctcgctcagctcctggggctcctgctgctctgtttcccaggtgccagatgtgacatccagatgacccagtctccatcctcactgtctgcatctgtgggagacagggtcaccttcacttgtcgggcgagtcagcgcattagcaattatttagcctggtttcagcagaaaccagggaaagcccctcagtccctgatctatgctgcattcaatttgcatagtggcgtcccatcaagattcagcgccagtggatctgggatagctttcactctcaccatcgccagcctgcagcccgaagattttgcaacttattactgccaacagtatgatgattacccgtacacttttggccaggggaccaagctggagatcaatcgaact

SEQ ID NO: 575761 - DNA, 483 bp, Homo sapiens
  misc_feature: HIJSMM301D3ULK.49.20.B09.1.454.light.4.raw
agtcgagagacacgaccggtgctcgatttagtgtagtgtgaaggggagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttacttcaccatcatcaacctgcagcctgaggatattgcaacatattactgtcaacaatatgataatctaccactcactttcggcggagggaccgacggtggagatcaaacgaactgtggctgcaccatctgtcttcatt

SEQ ID NO: 575762 - DNA, 454 bp, Homo sapiens; identical to SEQ ID NO: 534964
  misc_feature: HIJSMM301BI7QJ.19.86.H09.1.454.light.4.raw

SEQ ID NO: 575763 - DNA, 495 bp, Homo sapiens; identical to SEQ ID NO: 535486
  misc_feature: HIJSMM301BSDJO.26.72.G06.1.454.light.4.raw

SEQ ID NO: 575764 - DNA, 484 bp, Homo sapiens; identical to SEQ ID NO: 535211
  misc_feature: HIJSMM301AMC40.47.46.E02.1.454.light.4.raw

SEQ ID NO: 575765 - DNA, 512 bp, Homo sapiens; identical to SEQ ID NO: 542433
  misc_feature: HIJSMM301EKCEN.11.57.F02.1.454.light.4.raw

SEQ ID NO: 575766 - DNA, 485 bp, Homo sapiens; identical to SEQ ID NO: 549638
  misc_feature: HIJSMM301CCC5I.49.81.H04.1.454.light.4.raw

SEQ ID NO: 575767 - DNA, 517 bp, Homo sapiens
  misc_feature: HIJSMM301D7WRW.12.71.G05.1.454.light.4.raw
  modified_base (506)..(506): a, c, t, g, unknown or other
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagccaaggctgcccctcggcacttntcgtccctcct

SEQ ID NO: 575768 - DNA, 497 bp, Homo sapiens; identical to SEQ ID NO: 538061
  misc_feature: HIJSMM301EZ55F.16.46.E02.1.454.light.4.raw

SEQ ID NO: 575769 - DNA, 454 bp, Homo sapiens; identical to SEQ ID NO: 534964
  misc_feature: HIJSMM301EGVB0.19.86.H09.1.454.light.4.raw

SEQ ID NO: 575770 - DNA, 432 bp, Homo sapiens
  misc_feature: HIJSMM301EUACY.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccagggaccaagctggagatcaaacgaactgtggctgcaccatctgtcttcatcttcccgcatctgacatactcgta

SEQ ID NO: 575771 - DNA, 509 bp, Homo sapiens
  misc_feature: HIJSMM301BA2R9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcggtccgaacgggaccgaaggtaggaaatacaaacgaactagtggctgcaccatctgtcttctatcttccccg

SEQ ID NO: 575772 - DNA, 489 bp, Homo sapiens; identical to SEQ ID NO: 535139
  misc_feature: HIJSMM301A4PJN.14.55.E11.1.454.light.4.raw

SEQ ID NO: 575773 - DNA, 510 bp, Homo sapiens
  misc_feature: HIJSMM301BYWDV.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccgaaggtggagatcaaacgaactagtggctgcaccatctgtcttcta

SEQ ID NO: 575774 - DNA, 488 bp, Homo sapiens; identical to SEQ ID NO: 535725
  misc_feature: HIJSMM301DSD4W.12.88.H11.1.454.light.4.raw

SEQ ID NO: 575775 - DNA, 460 bp, Homo sapiens
  misc_feature: HIJSMM301COK3R.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttatactgtcagcaatataatactggcctccgctcacttcgtcggaggacgacggtagag

SEQ ID NO: 575776 - DNA, 485 bp, Homo sapiens
  misc_feature: HIJSMM301CHOIH.49.3.A03.1.454.light.4.raw
  modified_base (190)..(190): a, c, t, g, unknown or other
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccagggganagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccgggaccaaggtggagatcaaacgaactgtggctgcacatctgtt

SEQ ID NO: 575777 - DNA, 441 bp, Homo sapiens; identical to SEQ ID NO: 534971
  misc_feature: HIJSMM301B4H4N.11.3.A03.1.454.light.4.raw

SEQ ID NO: 575778 - DNA, 494 bp, Homo sapiens; identical to SEQ ID NO: 535828
  misc_feature: HIJSMM301ANIG4.3.36.D03.1.454.light.4.raw

SEQ ID NO: 575779 - DNA, 477 bp, Homo sapiens
  misc_feature: HIJSMM301A4Q16.43.38.D05.1.454.light.4.raw
tgtgagtagtcacgaccggtgctcgatttagtatctgatagttgggtttgggggctttccctggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtccctcaaggttcagcggcagtgcatctgggacagatttcactctcaccatcagcagcctgcagcctgatgattttgcaacttattactgtcaacagtataatagttacccctggacgttcggccaagggaccgagggtgggaaatacaaacgaaactgtggctgcaccatctgtcttctatcttcccgccactctgaactactcaca

SEQ ID NO: 575780 - DNA, 479 bp, Homo sapiens
  misc_feature: HIJSMM301ED10Y.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 575781 - DNA, 493 bp, Homo sapiens
  misc_feature: HIJSMM301CXR1D.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcgccaagggaccaaggtggagatcaaacgaactgtggctgcaccat

SEQ ID NO: 575782 - DNA, 473 bp, Homo sapiens; identical to SEQ ID NO: 535262
  misc_feature: HIJSMM301EP4K4.8.67.G01.1.454.light.4.raw

SEQ ID NO: 575783 - DNA, 505 bp, Homo sapiens
  misc_feature: HIJSMM301BSWML.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcacatctgtt

SEQ ID NO: 575784 - DNA, 496 bp, Homo sapiens
  misc_feature: HIJSMM301DJ6PT.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggtgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaagtcaaacgaactgtggctgcaccatctgtcttcatt

SEQ ID NO: 575785 - DNA, 498 bp, Homo sapiens
  misc_feature: HIJSMM301A837P.52.5.A05.1.454.light.4.raw
cgcagtacgacacgaccggtgctcgatttagatagatagacgggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcgagggactccctgagcgattctctggctccaattctaggaaatgcagccactctgaccatcagccgggacccagcctatggatgaggctgacttattactgtcaggcggtgggacgagttaggtttggtgtcttttcggcgggtagggaccgaagctgaccgtcctacgtcagcccaaggctcgccccctcggt

SEQ ID NO: 575786 - DNA, 496 bp, Homo sapiens; identical to SEQ ID NO: 536248
  misc_feature: HIJSMM301ADBML.22.27.C05.1.454.light.4.raw

SEQ ID NO: 575787 - DNA, 463 bp, Homo sapiens
  misc_feature: HIJSMM301DW3RH.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgcctcctccatactcgta

SEQ ID NO: 575788 - DNA, 493 bp, Homo sapiens
  misc_feature: HIJSMM301A3BZ5.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgagattaaacgaactgtggctgcaccatctgtctt

SEQ ID NO: 575789 - DNA, 454 bp, Homo sapiens; identical to SEQ ID NO: 534964
  misc_feature: HIJSMM301BOV1Y.19.86.H09.1.454.light.4.raw

SEQ ID NO: 575790 - DNA, 493 bp, Homo sapiens; identical to SEQ ID NO: 535047
  misc_feature: HIJSMM301DHTZP.16.53.E09.1.454.light.4.raw

SEQ ID NO: 575791 - DNA, 497 bp, Homo sapiens
  misc_feature: HIJSMM301EBLT6.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggcctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaa

SEQ ID NO: 575792 - DNA, 493 bp, Homo sapiens
  misc_feature: HIJSMM301C0GL5.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccgggtccctgacaggttcagtggcagtggatcaggcacagattttacactgaaaatcaacagagtggaggctgaggatgttggggtttattactgcatgcaagctctacaaactccctcaacgttcggcggagggaccaaggtggagatcaaacgaactgtggctgcaccatcttgtctttca

SEQ ID NO: 575793 - DNA, 498 bp, Homo sapiens
  misc_feature: HIJSMM301DZ95K.11.21.B10.1.454.light.4.raw
cgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttcccg

SEQ ID NO: 575794 - DNA, 447 bp, Homo sapiens; identical to SEQ ID NO: 541817
  misc_feature: HIJSMM301D6TUF.18.9.A09.1.454.light.4.raw

SEQ ID NO: 575795 - DNA, 521 bp, Homo sapiens; identical to SEQ ID NO: 538715
  misc_feature: HIJSMM301BY9CC.27.23.C01.1.454.light.4.raw

SEQ ID NO: 575796 - DNA, 515 bp, Homo sapiens; identical to SEQ ID NO: 560289
  misc_feature: HIJSMM301DRQK6.16.85.H08.1.454.light.4.raw

SEQ ID NO: 575797 - DNA, 501 bp, Homo sapiens; identical to SEQ ID NO: 542101
  misc_feature: HIJSMM301A9RWN.14.57.F02.1.454.light.4.raw

SEQ ID NO: 575798 - DNA, 518 bp, Homo sapiens; identical to SEQ ID NO: 557541
  misc_feature: HIJSMM301BYU22.9.86.H09.1.454.light.4.raw

SEQ ID NO: 575799 - DNA, 446 bp, Homo sapiens
  misc_feature: HIJSMM301AK30J.18.9.A09.1.454.light.4.raw
tacgagtatgcacgaccggtgctcgatttagcgagacgcgcagggtcctgggcccagtctgtgctgacgcagccgccctcagtgtctggggccccagggcagagggttaccatctcctgcactgggagcacctccaacatcggggcgggttatgatgtacactggtaccaacagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccaccctcctccatactcgta

SEQ ID NO: 575800 - DNA, 511 bp, Homo sapiens; identical to SEQ ID NO: 548439
  misc_feature: HIJSMM301A3A5C.16.46.E02.1.454.light.4.raw

SEQ ID NO: 575801 - DNA, 514 bp, Homo sapiens
  misc_feature: HIJSMM301DUL1S.19.59.F04.1.454.light.4.raw
  modified_base (235)..(235): a, c, t, g, unknown or other
  modified_base (243)..(243): a, c, t, g, unknown or other
tactctcgtgcacgaccggtgctcgatttagtacacacacttaggggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaanaattttgngtcctggtaccagcagctcccaggacagcccccaaactcctcattttgacaataataagcgaccctcacgggattccgtgaccgattctctggctccaagtctggcacgtcagccaccctgggcatcaccggactccagactggggacgaggcccgattattactgcggtaacatgggatagcagcctgagtactgtgataatcggcggagggaccaagctgaccgtcctaggtcagcccaaggctcgccccctcggtcactctgttcccg

SEQ ID NO: 575802 - DNA, 514 bp, Homo sapiens; identical to SEQ ID NO: 546238
  misc_feature: HIJSMM301BDW77.47.85.H08.1.454.light.4.raw

SEQ ID NO: 575803 - DNA, 501 bp, Homo sapiens; identical to SEQ ID NO: 555551
  misc_feature: HIJSMM301A29CQ.21.81.H04.1.454.light.4.raw

SEQ ID NO: 575804 - DNA, 510 bp, Homo sapiens; identical to SEQ ID NO: 563111
  misc_feature: HIJSMM301DFE5O.47.85.H08.1.454.light.4.raw

SEQ ID NO: 575805 - DNA, 491 bp, Homo sapiens
  misc_feature: HIJSMM301CWRW5.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgacgggtggaaagtacaaacgaactagtggctgcgaccatctgtctt

SEQ ID NO: 575806 - DNA, 499 bp, Homo sapiens
  misc_feature: HIJSMM301BGKM6.41.35.D02.1.454.light.4.raw
tctatactatcacgaccggtgctcgatttagcacacgatagttggggtttggggggggtcgacaagaggcagcgctctcgggacggtctccaccatggcctgggcgtctgctgctcctcactctcctcactcaggacacagggtccgtgggcccgacgtctgccctgactcagcctgcctccgtgtctgggtctcctggacagtcgatcaccatctcctgcactggtaccatcagcgatgttgattattataaccttgtctcctggtaccaacaacacccaggcaaagcccccaaacctcctgatttatgagggcgatcagcggccctcaggggtttctgatcgcttctctggctccaagtctggcaatacggcctccctgacagtctctcggctccaggcggaggacgaggctgattattactgcagctcatatacaagcagcagcactctcgtggtattcggcggagggaccaagctgaccgtcctaggtcagcccc

SEQ ID NO: 575807 - DNA, 475 bp, Homo sapiens; identical to SEQ ID NO: 551399
  misc_feature: HIJSMM301CO3OM.4.79.H02.1.454.light.4.raw

SEQ ID NO: 575808 - DNA, 489 bp, Homo sapiens
  misc_feature: HIJSMM301AGCJZ.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtacctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcattcc

SEQ ID NO: 575809 - DNA, 446 bp, Homo sapiens; identical to SEQ ID NO: 539491
  misc_feature: HIJSMM301C40KI.18.9.A09.1.454.light.4.raw

SEQ ID NO: 575810 - DNA, 500 bp, Homo sapiens; identical to SEQ ID NO: 542309
  misc_feature: HIJSMM301D3NU9.12.86.H09.1.454.light.4.raw

SEQ ID NO: 575811 - DNA, 484 bp, Homo sapiens; identical to SEQ ID NO: 535240
  misc_feature: HIJSMM301CY4E3.47.60.F05.1.454.light.4.raw

SEQ ID NO: 575812 - DNA, 508 bp, Homo sapiens
  misc_feature: HIJSMM301AF2YZ.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtaggcactttcgatgtcctattcggcggagggaccgaagctgaccgtcctgggtcagcccaaggctgccccctcggtcactctgttcccaccctccctctacgtcgtat

SEQ ID NO: 575813 - DNA, 524 bp, Homo sapiens
  misc_feature: HIJSMM301C6FJ4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgtccgaacgggaccgaacggtaggaaggtacgtaaacgaacgtacgtggcgtgcaccgaactctcgtcttctatcttcccgtcccact

SEQ ID NO: 575814 - DNA, 485 bp, Homo sapiens
  misc_feature: HIJSMM301AFFQ7.52.69.G03.1.454.light.4.raw
cgcagtacgacacgaccggtgctcgatttagtcgctgcgtaaaggagaaaggggagtcccagtcaggacacagcatggacatgagggtccccgctcagctcctggggctcctgctgctctgactcccaggtgccagatgtgacatccagttgacccagtctccatccttcctgtctgcatctgtgggggacagagtcaccatcacttgccggaccagtgaggacatctacactagattagcctggtatcagcaagaaccggggagagcccctaaactcctgatccatactgcatccactttgcatgctggggtcccattcaggttcggcggcagtggatctgggacagaattcactctcacaatcagcagcctgcagactgaagactccgcaatttattactgtcaacaacgtcaccgttacccgatcaccttcggccaagggacacggctggagattaaacgaactgtggctgcaccatctgtt

SEQ ID NO: 575815 - DNA, 516 bp, Homo sapiens
  misc_feature: HIJSMM301B2ASR.49.11.A11.1.454.light.4.raw
agtcgagagacacgaccggtgctcgatttagctacgactgcagggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcg

SEQ ID NO: 575816 - DNA, 515 bp, Homo sapiens
  misc_feature: HIJSMM301B566T.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcgagggaccaagctgaccgtcctaggtcagcccaaggctgccccctggtcactctgttcccacctcctcacg

SEQ ID NO: 575817 - DNA, 515 bp, Homo sapiens
  misc_feature: HIJSMM301AJTGH.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtcactctgttcccaccctcct

SEQ ID NO: 575818 - DNA, 523 bp, Homo sapiens
  misc_feature: HIJSMM301CVVFW.10.86.H09.1.454.light.4.raw
  modified_base (452)..(452): a, c, t, g, unknown or other
  modified_base (498)..(498): a, c, t, g, unknown or other
  modified_base (513)..(513): a, c, t, g, unknown or other
catagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccgggacgaggccgattattactgcgcaacttgggactcaaccctgactnttggggcttcggtcggagggacgtaagtgtacggtcctacgtctanccgacgacgcgcccncccggtctct

SEQ ID NO: 575819 - DNA, 504 bp, Homo sapiens
  misc_feature: HIJSMM301DE0VM.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgaccatcagtgggctccggtccgaggatgaggctgactattactgtgcatcacgggacgcaacatgggatgaacaatctgagcggttgggtgttcggcggagggaccaaactgacccgtctaggtcagcccaa

SEQ ID NO: 575820 - DNA, 513 bp, Homo sapiens
  misc_feature: HIJSMM301DKFGE.51.53.E09.1.454.light.4.raw
cgatcgtatacacgaccggtgctcgatttagagagagtgtgttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggacaaactgaccgtcctacgtcagcccaaggctgccccctcggtcactcttcg

SEQ ID NO: 575821 - DNA, 504 bp, Homo sapiens; identical to SEQ ID NO: 538521
  misc_feature: HIJSMM301DOA3S.9.12.B01.1.454.light.4.raw

SEQ ID NO: 575822 - DNA, 526 bp, Homo sapiens
  misc_feature: HIJSMM301AQG50.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacgggaccgaacggtaggaaggtacgaaacgaacgtagtaggcgtgcgaccatctgtcttctatcttcccgtcccactctgat

SEQ ID NO: 575823 - DNA, 501 bp, Homo sapiens
  misc_feature: HIJSMM301BCQL4.51.19.B08.1.454.light.4.raw
cgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgaggccagtaggcgagcctcagggatttctagtcgcttctctgcctccgcgtctggcaacacggcctccctgacaatttctgggctccagcctgaggacgagtctcactactactgctcctcatatgcagacaatagtttcctggtgttcggcggagggaccaagttgaccgtcctaggtcagcccaaggctcgccccctcggtcact

SEQ ID NO: 575824 - DNA, 511 bp, Homo sapiens
  misc_feature: HIJSMM301EW2G2.12.55.E11.1.454.light.4.raw
  modified_base (174)..(174): a, c, t, g, unknown or other
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactntgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgtctttgtttttttcggtcggtcgggaccaagctgaccgtcctaggtcagcccaaggctgccccctcggtcta

SEQ ID NO: 575825 - DNA, 485 bp, Homo sapiens; identical to SEQ ID NO: 545289
  misc_feature: HIJSMM301BXWW7.19.71.G05.1.454.light.4.raw

SEQ ID NO: 575826 - DNA, 454 bp, Homo sapiens; identical to SEQ ID NO: 536347
  misc_feature: HIJSMM301AU444.19.86.H09.1.454.light.4.raw

SEQ ID NO: 575827 - DNA, 487 bp, Homo sapiens; identical to SEQ ID NO: 536206
  misc_feature: HIJSMM301BUBSL.47.38.D05.1.454.light.4.raw

SEQ ID NO: 575828 - DNA, 511 bp, Homo sapiens
  misc_feature: HIJSMM301CUAOZ.17.33.C11.1.454.light.4.raw
  modified_base (463)..(463): a, c, t, g, unknown or other
cgtagactagcacgaccggtgctcgatttagagtgagctcgttgggtttgggggcgccaggggtcccttccaatatcagcaccatggcctgtactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtnttaagtcagcccaaggctgccccctcggtcactctgttcccaccctct

SEQ ID NO: 575829 - DNA, 488 bp, Homo sapiens
  misc_feature: HIJSMM301CL0VJ.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 575830 - DNA, 502 bp, Homo sapiens; identical to SEQ ID NO: 541971
  misc_feature: HIJSMM301EXNRH.4.39.D06.1.454.light.4.raw

SEQ ID NO: 575831 - DNA, 499 bp, Homo sapiens
  misc_feature: HIJSMM301CF25F.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaacccca

SEQ ID NO: 575832 - DNA, 502 bp, Homo sapiens; identical to SEQ ID NO: 541971
  misc_feature: HIJSMM301C01NG.4.39.D06.1.454.light.4.raw

SEQ ID NO: 575833 - DNA, 494 bp, Homo sapiens; identical to SEQ ID NO: 534994
  misc_feature: HIJSMM301C1OQB.27.78.H01.1.454.light.4.raw

SEQ ID NO: 575834 - DNA, 489 bp, Homo sapiens; identical to SEQ ID NO: 535386
  misc_feature: HIJSMM301DWXGV.12.51.E07.1.454.light.4.raw

SEQ ID NO: 575835 - DNA, 486 bp, Homo sapiens; identical to SEQ ID NO: 535043
  misc_feature: HIJSMM301C9DQM.46.35.D02.1.454.light.4.raw

SEQ ID NO: 575836 - DNA, 502 bp, Homo sapiens
  misc_feature: HIJSMM301C5R8I.40.55.E11.1.454.light.4.raw
tctagcgactcacgaccggtgctcgatttagcactcgcacgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctc

SEQ ID NO: 575837 - DNA, 446 bp, Homo sapiens
  misc_feature: HIJSMM301BK1BW.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcgggcggaggggaccaagctgaccgtcctaagtcagcccaaggctgccccctcggtcactctgttcccgccctcctccgtgtctgat

SEQ ID NO: 575838 - DNA, 496 bp, Homo sapiens
  misc_feature: HIJSMM301AOVY8.43.60.F05.1.454.light.4.raw
  modified_base (490)..(490): a, c, t, g, unknown or other
tgtgagtagtcacgaccggtgctcgatttagtacgtcatcagggaaagggcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtcgacggacgacggnggtacg

SEQ ID NO: 575839 - DNA, 504 bp, Homo sapiens
  misc_feature: HIJSMM301D0SYZ.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccacct

SEQ ID NO: 575840 - DNA, 483 bp, Homo sapiens
  misc_feature: HIJSMM301APJEU.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaactttggccaggggacaagctggagatacaacgaactgtggctgcaccat

SEQ ID NO: 575841 - DNA, 504 bp, Homo sapiens; identical to SEQ ID NO: 546845
  misc_feature: HIJSMM301AOUJI.53.49.E05.1.454.light.4.raw

SEQ ID NO: 575842 - DNA, 497 bp, Homo sapiens; identical to SEQ ID NO: 535886
  misc_feature: HIJSMM301BT8B0.8.10.A10.1.454.light.4.raw

SEQ ID NO: 575843 - DNA, 447 bp, Homo sapiens; identical to SEQ ID NO: 535201
  misc_feature: HIJSMM301CJ4HQ.18.9.A09.1.454.light.4.raw

SEQ ID NO: 575844 - DNA, 481 bp, Homo sapiens
  misc_feature: HIJSMM301AUTW0.4.34.D01.1.454.light.4.raw
agcactgtagcacgaccggtgctcgatttagatcgtctgtgttgggtttgggggctgtgggtccaggaggcagaactctgggtgtctcaccatggcctggatccctctacttctccccctcctcactctctgcacaggctctgagacctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttataaagagttcggcggagggaccaagctgaccgtcctaggtcagccc

SEQ ID NO: 575845 - DNA, 480 bp, Homo sapiens
  misc_feature: HIJSMM301D0BEO.52.26.C04.1.454.light.4.raw
cgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtggggacaggcaacactgtggtattcggcggagggaccaagctgaccgtcctaggtcagcccaagg

SEQ ID NO: 575846 - DNA, 447 bp, Homo sapiens; identical to SEQ ID NO: 535201
  misc_feature: HIJSMM301D56MV.18.9.A09.1.454.light.4.raw

SEQ ID NO: 575847 - DNA, 504 bp, Homo sapiens; identical to SEQ ID NO: 538940
  misc_feature: HIJSMM301AFD3B.2.35.D02.1.454.light.4.raw

SEQ ID NO: 575848 - DNA, 496 bp, Homo sapiens
  misc_feature: HIJSMM301EYKJU.49.62.F07.1.454.light.4.raw
agtcgagagacacgaccggtgctcgatttagtagtcgcataaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 575849 - DNA, 479 bp, Homo sapiens
  misc_feature: HIJSMM301BH9BR.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagatcaacgaactagtggctgcacc

SEQ ID NO: 575850 - DNA, 508 bp, Homo sapiens
  misc_feature: HIJSMM301D3GR3.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggtttcggcggtgggaccaagctgaccgtcctaagtcagcccaaggctgccccctcggtcactctgtt

SEQ ID NO: 575851 - DNA, 502 bp, Homo sapiens; identical to SEQ ID NO: 541971
  misc_feature: HIJSMM301ECYL8.4.39.D06.1.454.light.4.raw

SEQ ID NO: 575852 - DNA, 494 bp, Homo sapiens; identical to SEQ ID NO: 534994
  misc_feature: HIJSMM301ALJJY.27.78.H01.1.454.light.4.raw

SEQ ID NO: 575853 - DNA, 511 bp, Homo sapiens; identical to SEQ ID NO: 549837
  misc_feature: HIJSMM301DMH4Y.15.34.D01.1.454.light.4.raw

SEQ ID NO: 575854 - DNA, 504 bp, Homo sapiens; identical to SEQ ID NO: 538940
  misc_feature: HIJSMM301CSP7I.2.35.D02.1.454.light.4.raw

SEQ ID NO: 575855 - DNA, 496 bp, Homo sapiens; identical to SEQ ID NO: 546893
  misc_feature: HIJSMM301EM8PR.51.35.D02.1.454.light.4.raw

SEQ ID NO: 575856 - DNA, 487 bp, Homo sapiens; identical to SEQ ID NO: 568912
  misc_feature: HIJSMM301EBV6Y.14.55.E11.1.454.light.4.raw
  modified_base (427)..(427): a, c, t, g, unknown or other

SEQ ID NO: 575857 - DNA, 416 bp, Homo sapiens; identical to SEQ ID NO: 535308
  misc_feature: HIJSMM301D3DNW.16.46.E02.1.454.light.4.raw

SEQ ID NO: 575858 - DNA, 485 bp, Homo sapiens
  misc_feature: HIJSMM301DCLBG.49.56.F01.1.454.light.4.raw
agtcgagagacacgaccggtgctcgatttagcagacgtctgaacacacaaaggggagtcccagtcaggacacagcatggacatgagggtccccgctcagctcctggggctcctgctgctctggctcccaggtgccagatgtgacatccagttgacccagtctccatccttcctgtctgcatctgtcggagacagagtcaccatcacttgccgggccagtcagggcgttagtagttatttagcctggtatcaacaaaaccagggaaagcccctaacctcctgatatatgctgcaaccactttgtaaagtggggtcccatcaaggttcagcggcagtggatctgggacagagttcactctcactatcagcagcctgcagcctgaagattttgcaacttattattgccatcaagttgatgcttacccgctcactttcggcggagggaccaaggtggagatcagacgaactgtggctgcaccatctgtt

SEQ ID NO: 575859 - DNA, 493 bp, Homo sapiens
  misc_feature: HIJSMM301C3KKP.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtacttttctccggacacttttggccgggggaccaagctggagatcaaacgaactgtggctgcaccatctgtcttcta

SEQ ID NO: 575860 - DNA, 486 bp, Homo sapiens; identical to SEQ ID NO: 542999
  misc_feature: HIJSMM301C7NK1.17.55.E11.1.454.light.4.raw

SEQ ID NO: 575861 - DNA, 497 bp, Homo sapiens
  misc_feature: HIJSMM301DWEMV.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctcgcccctcggt

SEQ ID NO: 575862 - DNA, 497 bp, Homo sapiens
  misc_feature: HIJSMM301AE763.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtccgctcactttcggcgggggaccgaaggtaggagttctaaacgaactagtggctgcaccatctgtcttcatt

SEQ ID NO: 575863 - DNA, 494 bp, Homo sapiens; identical to SEQ ID NO: 535828
  misc_feature: HIJSMM301CIBWK.3.36.D03.1.454.light.4.raw

SEQ ID NO: 575864 - DNA, 444 bp, Homo sapiens; identical to SEQ ID NO: 534993
  misc_feature: HIJSMM301AXFAN.5.9.A09.1.454.light.4.raw

SEQ ID NO: 575865 - DNA, 485 bp, Homo sapiens
  misc_feature: HIJSMM301D6C4X.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtaggtggaggctgaggatgttggggtttattactgcatgcaagttctacaaacttctacacttttggccaggggaccaagctggagatcaaacgaa

SEQ ID NO: 575866 - DNA, 521 bp, Homo sapiens; identical to SEQ ID NO: 538715
  misc_feature: HIJSMM301BVGN6.27.23.C01.1.454.light.4.raw

SEQ ID NO: 575867 - DNA, 510 bp, Homo sapiens
  misc_feature: HIJSMM301B0EQY.17.33.C11.1.454.light.4.raw
cgtagactagcacgaccggtgctcgatttagagtgagctcgttgggtttgggggcgccaggggtcccttccaatatcagcaccatggcctggactcctctctttctgttcatcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccct

SEQ ID NO: 575868 - DNA, 514 bp, Homo sapiens
  misc_feature: HIJSMM301BFBAF.9.74.G08.1.454.light.4.raw
  modified_base (419)..(419): a, c, t, g, unknown or other
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaanagtgatcatccgggggtattcggcggagggaccaaggtgaccgtcctacgtcagcccaaggctgccccctcggtcactctgttcccgccctcctc

SEQ ID NO: 575869 - DNA, 419 bp, Homo sapiens
  misc_feature: HIJSMM301EAXF1.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 575870 - DNA, 469 bp, Homo sapiens
  misc_feature: HIJSMM301D4HDX.17.39.D06.1.454.light.4.raw
  modified_base (468)..(468): a, c, t, g, unknown or other
cgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagtattttgcggtttatactgtcagcagtataatcagtgcctcgtgacgttcgcaggacaggtgaatcaacgactgng

SEQ ID NO: 575871 - DNA, 500 bp, Homo sapiens
  misc_feature: HIJSMM301BZPBL.43.34.D01.1.454.light.4.raw
tgtgagtagtcacgaccggtgctcgatttagatcgtctgtgttgggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtccagcccaaggccaaccccactgtcactctgttcccaccctcctcactactcaca

SEQ ID NO: 575872 - DNA, 510 bp, Homo sapiens
  misc_feature: HIJSMM301A1YMV.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactcggtt

SEQ ID NO: 575873 - DNA, 486 bp, Homo sapiens; identical to SEQ ID NO: 535043
  misc_feature: HIJSMM301CE9MK.46.35.D02.1.454.light.4.raw

SEQ ID NO: 575874 - DNA, 479 bp, Homo sapiens
  misc_feature: HIJSMM301C00UC.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtgttttggctgttcggcggcgggacc

SEQ ID NO: 575875 - DNA, 514 bp, Homo sapiens; identical to SEQ ID NO: 538153
  misc_feature: HIJSMM301C5P8P.17.37.D04.1.454.light.4.raw

SEQ ID NO: 575876 - DNA, 496 bp, Homo sapiens; identical to SEQ ID NO: 535541
  misc_feature: HIJSMM301ATBWM.3.33.C11.1.454.light.4.raw

SEQ ID NO: 575877 - DNA, 488 bp, Homo sapiens; identical to SEQ ID NO: 536742
  misc_feature: HIJSMM301BC9KN.3.72.G06.1.454.light.4.raw

SEQ ID NO: 575878 - DNA, 517 bp, Homo sapiens
  misc_feature: HIJSMM301BIY60.26.72.G06.1.454.light.4.raw
agactatactcacgaccggtgctcgatttagctacgactgcaagggaaaggggcagcaagatggtgttacagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagactgatattaacagacgaaaagagatttttgttaaggggaaagtaatgaagttaactac

SEQ ID NO: 575879 - DNA, 492 bp, Homo sapiens
  misc_feature: HIJSMM301DHAOS.40.81.H04.1.454.light.4.raw
tctagcgactcacgaccggtgctcgatttagtagtgtagattcgcgggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaaactgtgtggacggtcggccaagggaccaaaggtggaaatcaagcgaactgtggctgca

SEQ ID NO: 575880 - DNA, 454 bp, Homo sapiens; identical to SEQ ID NO: 534964
  misc_feature: HIJSMM301CGN7R.19.86.H09.1.454.light.4.raw

SEQ ID NO: 575881 - DNA, 503 bp, Homo sapiens
  misc_feature: HIJSMM301BRSBF.48.57.F02.1.454.light.4.raw
agtatacatacacgaccggtgctcgatttagctcgatatagttgggtttgggggaggaactgctcagttaggacccagagggaaccatggaagcccccgcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 575882 - DNA, 489 bp, Homo sapiens; identical to SEQ ID NO: 535091
  misc_feature: HIJSMM301ENJP2.47.36.D03.1.454.light.4.raw

SEQ ID NO: 575883 - DNA, 501 bp, Homo sapiens
  misc_feature: HIJSMM301C12ED.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtctaggtcagcccaaggccaaccccactgtca

SEQ ID NO: 575884 - DNA, 507 bp, Homo sapiens; identical to SEQ ID NO: 540930
  misc_feature: HIJSMM301BSEZY.8.34.D01.1.454.light.4.raw

SEQ ID NO: 575885 - DNA, 491 bp, Homo sapiens
  misc_feature: HIJSMM301B5TVH.49.67.G01.1.454.light.4.raw
agtcgagagacacgaccggtgctcgatttagagtatacatattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtt

SEQ ID NO: 575886 - DNA, 496 bp, Homo sapiens; identical to SEQ ID NO: 538394
  misc_feature: HIJSMM301C3SGO.22.86.H09.1.454.light.4.raw

SEQ ID NO: 575887 - DNA, 513 bp, Homo sapiens; identical to SEQ ID NO: 545469
  misc_feature: HIJSMM301CSM6D.8.23.C01.1.454.light.4.raw

SEQ ID NO: 575888 - DNA, 497 bp, Homo sapiens
  misc_feature: HIJSMM301BMRK7.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccgagggtggaaatcaaacgaactagtggctgcaccatctgtcttcatt

SEQ ID NO: 575889 - DNA, 476 bp, Homo sapiens
  misc_feature: HIJSMM301C7W5D.16.86.H09.1.454.light.4.raw
tgtactactccacgaccggtgctcgatttagtgctatagacttgggtttgggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcagggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgcctcctcgagtagtaca

SEQ ID NO: 575890 - DNA, 498 bp, Homo sapiens; identical to SEQ ID NO: 547685
  misc_feature: HIJSMM301EWU65.19.10.A10.1.454.light.4.raw

SEQ ID NO: 575891 - DNA, 497 bp, Homo sapiens
  misc_feature: HIJSMM301AGMGM.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgctagtttattactgtcagcagtataataactggcctccgtacatgtactacttttggccgaggggaccaaccgtggagatcagacgaa

SEQ ID NO: 575892 - DNA, 486 bp, Homo sapiens; identical to SEQ ID NO: 535917
  misc_feature: HIJSMM301ETEL0.3.10.A10.1.454.light.4.raw

SEQ ID NO: 575893 - DNA, 465 bp, Homo sapiens
  misc_feature: HIJSMM301BA1A0.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatcgtgggacagactttactctcaccatcagcagcctgcagcctgaagatattgcaacatattactgtcaacagtatgatcgtctcctctaatttcggccctgggaccagagtggacatgaaacgaa

SEQ ID NO: 575894 - DNA, 511 bp, Homo sapiens; identical to SEQ ID NO: 546062
  misc_feature: HIJSMM301CWO7L.5.58.F03.1.454.light.4.raw

SEQ ID NO: 575895 - DNA, 472 bp, Homo sapiens
  misc_feature: HIJSMM301DHSW3.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctggtcttcatcttccgccat

SEQ ID NO: 575896 - DNA, 497 bp, Homo sapiens
  misc_feature: HIJSMM301B6VSI.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctg

SEQ ID NO: 575897 - DNA, 493 bp, Homo sapiens
  misc_feature: HIJSMM301D6GS0.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgaactgtggctgcaccatctgtcttcta

SEQ ID NO: 575898 - DNA, 490 bp, Homo sapiens; identical to SEQ ID NO: 562759
  misc_feature: HIJSMM301D95BH.19.71.G05.1.454.light.4.raw

SEQ ID NO: 575899 - DNA, 520 bp, Homo sapiens
  misc_feature: HIJSMM301ALRE8.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgcgacggacgaacggtaggaagtacaacgaactagtggcgtgcaccactctcgttcttctactcttcccgtccctactctcgat

SEQ ID NO: 575900 - DNA, 508 bp, Homo sapiens
  misc_feature: HIJSMM301AP008.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcact

SEQ ID NO: 575901 - DNA, 466 bp, Homo sapiens; identical to SEQ ID NO: 556852
  misc_feature: HIJSMM301EKXWI.48.2.A02.1.454.light.4.raw

SEQ ID NO: 575902 - DNA, 486 bp, Homo sapiens
  misc_feature: HIJSMM301BLX3J.48.73.G07.1.454.light.4.raw
agtatacatacacgaccggtgctcgatttagctctacgctcagggcacgaccggtgctcgatttagacgcgatcgaagggtttgggggggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggacc

SEQ ID NO: 575903 - DNA, 504 bp, Homo sapiens; identical to SEQ ID NO: 535077
  misc_feature: HIJSMM301BAEXP.8.28.C06.1.454.light.4.raw

SEQ ID NO: 575904 - DNA, 491 bp, Homo sapiens
  misc_feature: HIJSMM301CAEHA.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttatactgtcaacaatattataataatccatttaatttcggcggagggaccaaggtggagatcaaacgaactgtggctgcaccatctgtcttcatcttcccgccta

SEQ ID NO: 575905 - DNA, 444 bp, Homo sapiens; identical to SEQ ID NO: 534993
  misc_feature: HIJSMM301AYPBQ.5.9.A09.1.454.light.4.raw

SEQ ID NO: 575906 - DNA, 476 bp, Homo sapiens
  misc_feature: HIJSMM301DT2PP.51.76.G10.1.454.light.4.raw
cgatcgtatacacgaccggtgctcgatttagtcactcatacaggggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaggggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcacc

SEQ ID NO: 575907 - DNA, 516 bp, Homo sapiens
  misc_feature: HIJSMM301CGSMR.49.9.A09.1.454.light.4.raw
agtcgagagacacgaccggtgctcgatttagcgagacgcgcagggcacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctaccg

SEQ ID NO: 575908 - DNA, 502 bp, Homo sapiens; identical to SEQ ID NO: 537816
  misc_feature: HIJSMM301A9082.19.78.H01.1.454.light.4.raw

SEQ ID NO: 575909 - DNA, 499 bp, Homo sapiens
  misc_feature: HIJSMM301CTZY9.43.69.G03.1.454.light.4.raw
tgtgagtagtcacgaccggtgctcgatttagtcgctgcgtaaaggagaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggccaccacctcgtcactc

SEQ ID NO: 575910 - DNA, 416 bp, Homo sapiens; identical to SEQ ID NO: 545902
  misc_feature: HIJSMM301AE9TF.18.78.H01.1.454.light.4.raw

SEQ ID NO: 575911 - DNA, 479 bp, Homo sapiens; identical to SEQ ID NO: 535188
  misc_feature: HIJSMM301B18EU.10.74.G08.1.454.light.4.raw

SEQ ID NO: 575912 - DNA, 513 bp, Homo sapiens; identical to SEQ ID NO: 555055
  misc_feature: HIJSMM301D4A3W.15.76.G10.1.454.light.4.raw

SEQ ID NO: 575913 - DNA, 475 bp, Homo sapiens; identical to SEQ ID NO: 537570
  misc_feature: HIJSMM301DGXQE.13.4.A04.1.454.light.4.raw

SEQ ID NO: 575914 - DNA, 501 bp, Homo sapiens
  misc_feature: HIJSMM301EHEK3.51.79.H02.1.454.light.4.raw
cgatcgtatacacgaccggtgctcgatttagtgtcacacgaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccaggggaccaagctcgagatcaaacgaactgtggctgcacatct

SEQ ID NO: 575915 - DNA, 474 bp, Homo sapiens
  misc_feature: HIJSMM301CTNLM.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactagaaaaacagccgggtggagagtgaccatgttggaacttattactgcatgc

SEQ ID NO: 575916 - DNA, 496 bp, Homo sapiens; identical to SEQ ID NO: 535109
  misc_feature: HIJSMM301BO59I.16.78.H01.1.454.light.4.raw

SEQ ID NO: 575917 - DNA, 472 bp, Homo sapiens; identical to SEQ ID NO: 536302
  misc_feature: HIJSMM301EJLND.18.76.G10.1.454.light.4.raw

SEQ ID NO: 575918 - DNA, 504 bp, Homo sapiens; identical to SEQ ID NO: 542288
  misc_feature: HIJSMM301BA31Y.8.28.C06.1.454.light.4.raw

SEQ ID NO: 575919 - DNA, 494 bp, Homo sapiens; identical to SEQ ID NO: 534992
  misc_feature: HIJSMM301DKJJC.9.1.A01.1.454.light.4.raw

SEQ ID NO: 575920 - DNA, 503 bp, Homo sapiens
  misc_feature: HIJSMM301BN23C.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctgggacagacttcactctcaccatcagtagactggagcctgaagattttgcagtttattactgtcagcagtatgggggctcacgtcgattcactttcggccctgggaccaagtagatgtcaaacgaactagtggctgcaccatctgtctt

SEQ ID NO: 575921 - DNA, 498 bp, Homo sapiens
  misc_feature: HIJSMM301BHYN1.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatcttcccgcctat

SEQ ID NO: 575922 - DNA, 477 bp, Homo sapiens
  misc_feature: HIJSMM301CPKZU.51.76.G10.1.454.light.4.raw
cgatcgtatacacgaccggtgctcgatttagtcactcatacaggggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcactataataactggcctccgtacacttttggccaggggaccaagctggagatacaaacgaactgtggctgcacc

SEQ ID NO: 575923 - DNA, 486 bp, Homo sapiens; identical to SEQ ID NO: 535385
  misc_feature: HIJSMM301B3N6X.19.71.G05.1.454.light.4.raw

SEQ ID NO: 575924 - DNA, 482 bp, Homo sapiens
  misc_feature: HIJSMM301C225R.41.47.E03.1.454.light.4.raw
tctatactatcacgaccggtgctcgatttagactcgcgcacagagagaaggggtgatcaggactcctcagttcaccttctcacaatgaggctccctgctcagctcctggggctgctaatgctctgggtctctggatctagtggagagattgtgatgagtcagtctccacgctccctgtccgtcacccctggagagtcggcctccatctcctgcaagtcgagtcacaacctcctgtatagtaatggatacaattatgtggattggtacgtgcagaagccagggcagtctccacaactcctcatctatttggttctcatcgggactccggggtccctgacaggttcactggcagtggatcaggcacagattttaccctagaaatcagtagagtggaggctgaggatgttggcgactattactgcctgcaagctcggcaattcccgatcaccttcggccccggacacgactggacattaaacgaa

SEQ ID NO: 575925 - DNA, 502 bp, Homo sapiens
  misc_feature: HIJSMM301EQVSM.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggtcaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccacctgaccatcagcagggtcgaagccggggatgaggccgactattactgtcaggcgtgggacagcagcactccctatgtcttcggcactgggaccaaggtcaccgtcctaggtcagcccaaggccaaccccactgtcactctgtt

SEQ ID NO: 575926 - DNA, 500 bp, Homo sapiens
  misc_feature: HIJSMM301BLPXX.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatcctgtcttcatcttcccgccatctgacta

SEQ ID NO: 575927 - DNA, 491 bp, Homo sapiens
  misc_feature: HIJSMM301BVMMU.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgcttcat

SEQ ID NO: 575928 - DNA, 513 bp, Homo sapiens
  misc_feature: HIJSMM301DYXC2.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagcccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 575929 - DNA, 484 bp, Homo sapiens; identical to SEQ ID NO: 535441
  misc_feature: HIJSMM301E09ZK.26.60.F05.1.454.light.4.raw

SEQ ID NO: 575930 - DNA, 454 bp, Homo sapiens; identical to SEQ ID NO: 535005
  misc_feature: HIJSMM301B2N8J.19.86.H09.1.454.light.4.raw

SEQ ID NO: 575931 - DNA, 485 bp, Homo sapiens; identical to SEQ ID NO: 536527
  misc_feature: HIJSMM301CJPE2.3.77.G11.1.454.light.4.raw

SEQ ID NO: 575932 - DNA, 499 bp, Homo sapiens; identical to SEQ ID NO: 536578
  misc_feature: HIJSMM301DIJ19.22.27.C05.1.454.light.4.raw

SEQ ID NO: 575933 - DNA, 498 bp, Homo sapiens
  misc_feature: HIJSMM301DVBP9.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcaccgtgggtacttttggccgaggggaccaagctggagatacaaacgaactgtggctgcaccatctgtctt

SEQ ID NO: 575934 - DNA, 506 bp, Homo sapiens
  misc_feature: HIJSMM301D5BYY.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctcgtttccgccct

SEQ ID NO: 575935 - DNA, 515 bp, Homo sapiens; identical to SEQ ID NO: 538755
  misc_feature: HIJSMM301BM4RR.14.70.G04.1.454.light.4.raw

SEQ ID NO: 575936 - DNA, 493 bp, Homo sapiens; identical to SEQ ID NO: 535745
  misc_feature: HIJSMM301CTUD6.47.78.H01.1.454.light.4.raw

SEQ ID NO: 575937 - DNA, 485 bp, Homo sapiens; identical to SEQ ID NO: 535985
  misc_feature: HIJSMM301ASMB7.15.1.A01.1.454.light.4.raw

SEQ ID NO: 575938 - DNA, 486 bp, Homo sapiens
  misc_feature: HIJSMM301C7BIA.43.4.A04.1.454.light.4.raw
tgtgagtagtcacgaccggtgctcgatttagagtagtgatcagggggaaggagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcggccaagggaccaaggtggacatcaacgaactgtggctgcacc

SEQ ID NO: 575939 - DNA, 488 bp, Homo sapiens
  misc_feature: HIJSMM301AS04H.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacacggctaggaaactaaacgaactagtggctgcacca

SEQ ID NO: 575940 - DNA, 487 bp, Homo sapiens; identical to SEQ ID NO: 554064
  misc_feature: HIJSMM301CYQMO.17.25.C03.1.454.light.4.raw

SEQ ID NO: 575941 - DNA, 486 bp, Homo sapiens
  misc_feature: HIJSMM301ECDXP.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggaggaccaaggcggagatcagacgaactgtggctgcacatctgtcttca

SEQ ID NO: 575942 - DNA, 508 bp, Homo sapiens; identical to SEQ ID NO: 537871
  misc_feature: HIJSMM301B33OO.8.33.C11.1.454.light.4.raw

SEQ ID NO: 575943 - DNA, 486 bp, Homo sapiens; identical to SEQ ID NO: 535043
  misc_feature: HIJSMM301AKSRE.46.35.D02.1.454.light.4.raw

SEQ ID NO: 575944 - DNA, 481 bp, Homo sapiens
  misc_feature: HIJSMM301DHFBR.3.5.A05.1.454.light.4.raw
agacgcactccacgaccggtgctcgatttagatagatagacagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcaccatctgt

SEQ ID NO: 575945 - DNA, 496 bp, Homo sapiens
  misc_feature: HIJSMM301AYC8T.43.55.E11.1.454.light.4.raw
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatcaaacgaaactgtggctgcaccatctgtcttctat

SEQ ID NO: 575946 - DNA, 453 bp, Homo sapiens; identical to SEQ ID NO: 563514
  misc_feature: HIJSMM301D3M1D.19.86.H09.1.454.light.4.raw

SEQ ID NO: 575947 - DNA, 443 bp, Homo sapiens; identical to SEQ ID NO: 572066
  misc_feature: HIJSMM301DE50Z.9.9.A09.1.454.light.4.raw

SEQ ID NO: 575948 - DNA, 493 bp, Homo sapiens; identical to SEQ ID NO: 548028
  misc_feature: HIJSMM301A9FAG.19.83.H06.1.454.light.4.raw

SEQ ID NO: 575949 - DNA, 490 bp, Homo sapiens; identical to SEQ ID NO: 535234
  misc_feature: HIJSMM301AHV0M.17.21.B10.1.454.light.4.raw

SEQ ID NO: 575950 - DNA, 501 bp, Homo sapiens
  misc_feature: HIJSMM301CKDOA.48.67.G01.1.454.light.4.raw
agtatacatacacgaccggtgctcgatttagagtatacatattgggttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttccccg

SEQ ID NO: 575951 - DNA, 489 bp, Homo sapiens; identical to SEQ ID NO: 540655
  misc_feature: HIJSMM301AQNPM.22.87.H10.1.454.light.4.raw

SEQ ID NO: 575952 - DNA, 486 bp, Homo sapiens; identical to SEQ ID NO: 535043
  misc_feature: HIJSMM301D3D9N.46.35.D02.1.454.light.4.raw

SEQ ID NO: 575953 - DNA, 516 bp, Homo sapiens
  misc_feature: HIJSMM301BV4HG.12.28.C06.1.454.light.4.raw
  modified_base (509)..(509): a, c, t, g, unknown or other
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtccccccggacgttcggtccacgggaccgacacgtaggaaatagagacgaaacgtacgtggctggcaccactctgtcttctactnttcccgt

SEQ ID NO: 575954 - DNA, 505 bp, Homo sapiens; identical to SEQ ID NO: 535503
  misc_feature: HIJSMM301ESMYX.8.28.C06.1.454.light.4.raw

SEQ ID NO: 575955 - DNA, 491 bp, Homo sapiens
  misc_feature: HIJSMM301CZDZF.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggaggatcaaacgaactgtggctgcacccat

SEQ ID NO: 575956 - DNA, 501 bp, Homo sapiens
  misc_feature: HIJSMM301B3AYN.2.76.G10.1.454.light.4.raw
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctggtgcttatctcttcggacctgggaccaaggtcaccgtccttggt

SEQ ID NO: 575957 - DNA, 500 bp, Homo sapiens
  misc_feature: HIJSMM301BOLY8.16.86.H09.1.454.light.4.raw
tgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccccg

SEQ ID NO: 575958 - DNA, 508 bp, Homo sapiens
  misc_feature: HIJSMM301C2ZXD.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacttcggccctgggaccgaaggtggagatcaaacgaactgtggctgcaccatctgtcttcta

SEQ ID NO: 575959 - DNA, 496 bp, Homo sapiens; identical to SEQ ID NO: 537925
  misc_feature: HIJSMM301AK0ZA.22.14.B03.1.454.light.4.raw

SEQ ID NO: 575960 - DNA, 502 bp, Homo sapiens
  misc_feature: HIJSMM301E3IWV.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggtagagggtcgccatctcctgcactgggtccacctccaatatcggggccggttatggtatgctctggtatcaacaacgtccaggaatggcccccaaactcctcatctatgctgacaacaatcgaccttcaggggtcccgtgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaagg

SEQ ID NO: 575961 - DNA, 479 bp, Homo sapiens; identical to SEQ ID NO: 556086
  misc_feature: HIJSMM301BKX7J.10.74.G08.1.454.light.4.raw

SEQ ID NO: 575962 - DNA, 498 bp, Homo sapiens
  misc_feature: HIJSMM301DQ6Z6.52.51.E07.1.454.light.4.raw
cgcagtacgacacgaccggtgctcgatttagcatactctacaacacacaaaggggcagcaagatggtgttgcagacccaggtcttcatttctctgttgctctggatctctggtgtctacggggacttcgtgctgacccagtctccagactccctggctgtgtctctgggcgcgagggccaccatcaactgcaagtccagccggagtgttttctggcgccccaccgataagaactacttagcttggtatcagcacaaaccaggacaccctcccaaactcctcatttcctgggcatctacccggggaatccggggtccctgaccgattcagtggcagcgggtctgagacggatttcactctcaccatcagcagcctgcaggctgaagatgtggcagtgtattactgtcagcagtatgctggtactccctacacttttggccaggggaccaaggtggagatcaaacgaactgtggctgcaccatctgtcttcatcttcccg

SEQ ID NO: 575963 - DNA, 496 bp, Homo sapiens; identical to SEQ ID NO: 546893
  misc_feature: HIJSMM301AE2DX.51.35.D02.1.454.light.4.raw

SEQ ID NO: 575964 - DNA, 494 bp, Homo sapiens; identical to SEQ ID NO: 536974
  misc_feature: HIJSMM301B9SSL.16.86.H09.1.454.light.4.raw

SEQ ID NO: 575965 - DNA, 488 bp, Homo sapiens; identical to SEQ ID NO: 536742
  misc_feature: HIJSMM301CN9H5.3.72.G06.1.454.light.4.raw

SEQ ID NO: 575966 - DNA, 485 bp, Homo sapiens
  misc_feature: HIJSMM301EJ98X.46.35.D02.1.454.light.4.raw
  modified_base (480)..(480): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgnaccat

SEQ ID NO: 575967 - DNA, 485 bp, Homo sapiens; identical to SEQ ID NO: 535822
  misc_feature: HIJSMM301DPAIH.14.53.E09.1.454.light.4.raw

SEQ ID NO: 575968 - DNA, 494 bp, Homo sapiens; identical to SEQ ID NO: 534994
  misc_feature: HIJSMM301ESHTK.27.78.H01.1.454.light.4.raw

SEQ ID NO: 575969 - DNA, 476 bp, Homo sapiens; identical to SEQ ID NO: 537368
  misc_feature: HIJSMM301DY9ZP.7.83.H06.1.454.light.4.raw

SEQ ID NO: 575970 - DNA, 518 bp, Homo sapiens
  misc_feature: HIJSMM301EE89D.49.73.G07.1.454.light.4.raw
agtcgagagacacgaccggtgctcgatttagctctacgctcagggcacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcttccgggggtgttcggcggagggaccaagttgaccgtcgtggtcagcccaaggctcg

SEQ ID NO: 575971 - DNA, 480 bp, Homo sapiens; identical to SEQ ID NO: 549459
  misc_feature: HIJSMM301D5J79.21.25.C03.1.454.light.4.raw

SEQ ID NO: 575972 - DNA, 487 bp, Homo sapiens; identical to SEQ ID NO: 559093
  misc_feature: HIJSMM301E1B0S.19.71.G05.1.454.light.4.raw

SEQ ID NO: 575973 - DNA, 513 bp, Homo sapiens
  misc_feature: HIJSMM301C0WRE.43.23.C01.1.454.light.4.raw
tgtgagtagtcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgtt

SEQ ID NO: 575974 - DNA, 354 bp, Homo sapiens; identical to SEQ ID NO: 535026
  misc_feature: HIJSMM301DT7BU.19.22.B11.1.454.light.4.raw

SEQ ID NO: 575975 - DNA, 501 bp, Homo sapiens
  misc_feature: HIJSMM301CVO7E.43.34.D01.1.454.light.4.raw
tgtgagtagtcacgaccggtgctcgatttagatcgtctgtgttgggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgtccctaccctcctcactactcacacg

SEQ ID NO: 575976 - DNA, 496 bp, Homo sapiens; identical to SEQ ID NO: 540287
  misc_feature: HIJSMM301DW847.40.11.A11.1.454.light.4.raw

SEQ ID NO: 575977 - DNA, 521 bp, Homo sapiens; identical to SEQ ID NO: 539470
  misc_feature: HIJSMM301DGRPJ.27.23.C01.1.454.light.4.raw

SEQ ID NO: 575978 - DNA, 503 bp, Homo sapiens
  misc_feature: HIJSMM301CUQHC.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctgtctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagccccaa

SEQ ID NO: 575979 - DNA, 469 bp, Homo sapiens; identical to SEQ ID NO: 555674
  misc_feature: HIJSMM301AMLWM.3.68.G02.1.454.light.4.raw

SEQ ID NO: 575980 - DNA, 494 bp, Homo sapiens; identical to SEQ ID NO: 534992
  misc_feature: HIJSMM301CFXNY.9.1.A01.1.454.light.4.raw

SEQ ID NO: 575981 - DNA, 482 bp, Homo sapiens
  misc_feature: HIJSMM301A0V71.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtgtggcccgctcattttcggcgagggaccaaggtgcagatcaaacgaactgtggctgca

SEQ ID NO: 575982 - DNA, 517 bp, Homo sapiens
  misc_feature: HIJSMM301AGXNM.17.33.C11.1.454.light.4.raw
cgtagactagcacgaccggtgctcgatttagagtgagctcgttggggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcgactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcctcctcc

SEQ ID NO: 575983 - DNA, 508 bp, Homo sapiens; identical to SEQ ID NO: 537871
  misc_feature: HIJSMM301BAR4T.8.33.C11.1.454.light.4.raw

SEQ ID NO: 575984 - DNA, 472 bp, Homo sapiens; identical to SEQ ID NO: 535898
  misc_feature: HIJSMM301BTQ3M.15.8.A08.1.454.light.4.raw

SEQ ID NO: 575985 - DNA, 513 bp, Homo sapiens; identical to SEQ ID NO: 535244
  misc_feature: HIJSMM301BTV3W.17.33.C11.1.454.light.4.raw

SEQ ID NO: 575986 - DNA, 485 bp, Homo sapiens
  misc_feature: HIJSMM301BOP7G.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttggcggagggaccaaggtggagatcaaacgaacg

SEQ ID NO: 575987 - DNA, 474 bp, Homo sapiens; identical to SEQ ID NO: 558221
  misc_feature: HIJSMM301ENKNB.12.49.E05.1.454.light.4.raw

SEQ ID NO: 575988 - DNA, 479 bp, Homo sapiens
  misc_feature: HIJSMM301B7HBW.51.34.D01.1.454.light.4.raw
cgatcgtatacacgaccggtgctcgatttagatcgtctgtgttgggtttggggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcgggggaccgaaggtggagatcaagcgaactgtggctgcacatctgt

SEQ ID NO: 575989 - DNA, 454 bp, Homo sapiens; identical to SEQ ID NO: 536943
  misc_feature: HIJSMM301A1FEZ.19.86.H09.1.454.light.4.raw

SEQ ID NO: 575990 - DNA, 502 bp, Homo sapiens; identical to SEQ ID NO: 573431
  misc_feature: HIJSMM301AP8YZ.5.60.F05.1.454.light.4.raw

SEQ ID NO: 575991 - DNA, 515 bp, Homo sapiens
  misc_feature: HIJSMM301C75M1.49.57.F02.1.454.light.4.raw
agtcgagagacacgaccggtgctcgatttagctcgatatagttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactaactcatagggtgttcggcggagggaccaagctgaccgtcctaggtcagcccaaggctgccccctcggtcactctgttcccgccctt

SEQ ID NO: 575992 - DNA, 487 bp, Homo sapiens; identical to SEQ ID NO: 538190
  misc_feature: HIJSMM301BJDUF.47.70.G04.1.454.light.4.raw

SEQ ID NO: 575993 - DNA, 484 bp, Homo sapiens; identical to SEQ ID NO: 535211
  misc_feature: HIJSMM301DE2WC.47.46.E02.1.454.light.4.raw

SEQ ID NO: 575994 - DNA, 492 bp, Homo sapiens; identical to SEQ ID NO: 535126
  misc_feature: HIJSMM301A1AH3.18.11.A11.1.454.light.4.raw

SEQ ID NO: 575995 - DNA, 502 bp, Homo sapiens
  misc_feature: HIJSMM301BY18W.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactagggctcaggcggaagatgaggctgactattactgtaactcccgggacagcagtgctgaccaggtggtattcggcggagggacccacctgaccgtcttaggtcagcccaaggctgccccctcggtcac

SEQ ID NO: 575996 - DNA, 476 bp, Homo sapiens; identical to SEQ ID NO: 547708
  misc_feature: HIJSMM301CSRQW.12.1.A01.1.454.light.4.raw

SEQ ID NO: 575997 - DNA, 494 bp, Homo sapiens
  misc_feature: HIJSMM301AF7IS.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatacaaacgaactgtggctgcaccatctgtcttcatccttcccgccat

SEQ ID NO: 575998 - DNA, 504 bp, Homo sapiens
  misc_feature: HIJSMM301BN762.48.55.E11.1.454.light.4.raw
agtatacatacacgaccggtgctcgatttagcactcgcacgttggggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgccccctc

SEQ ID NO: 575999 - DNA, 484 bp, Homo sapiens
  misc_feature: HIJSMM301BM7M6.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgatggccgtacacttttggccaggggaccaagctggagatcaaacgaactgtggctgcacc

SEQ ID NO: 576000 - DNA, 517 bp, Homo sapiens
  misc_feature: HIJSMM301BCZSY.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccgaacggaccgaacggtaggaaggtacaaacgaactagtggcgtgcaccactctgtcttctatcttcccgtcccact

SEQ ID NO: 576001 - DNA, 507 bp, Homo sapiens; identical to SEQ ID NO: 556766
  misc_feature: HIJSMM301COAX6.8.34.D01.1.454.light.4.raw

SEQ ID NO: 576002 - DNA, 484 bp, Homo sapiens
  misc_feature: HIJSMM301BH0GU.48.72.G06.1.454.light.4.raw
agtatacatacacgaccggtgctcgatttagctacgactgcaagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttatactgtcagcagtatgataactggcctccgttcaccttcggcggcgggaccaaggtggagatcaaacgaa

SEQ ID NO: 576003 - DNA, 499 bp, Homo sapiens
  misc_feature: HIJSMM301AGN2M.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattactttgtcttcggaactgggaccaaggtcaccgtcctaggtcacgcccaacggccaaccccactgtcactctgttcccaccctcctcgagtagtaca

SEQ ID NO: 576004 - DNA, 483 bp, Homo sapiens; identical to SEQ ID NO: 536202
  misc_feature: HIJSMM301DLQEH.43.24.C02.1.454.light.4.raw

SEQ ID NO: 576005 - DNA, 503 bp, Homo sapiens; identical to SEQ ID NO: 536834
  misc_feature: HIJSMM301AXI8D.2.35.D02.1.454.light.4.raw

SEQ ID NO: 576006 - DNA, 513 bp, Homo sapiens
  misc_feature: HIJSMM301A7P1Z.52.35.D02.1.454.light.4.raw
cgcagtacgacacgaccggtgctcgatttagcacacgatagttgggtttgggcctaaggaagcagcactggtggtgcctcagccatggcctggaccgttctcctcctcggcctcctctctcactgcacagactatgtgacttcctatgtgctgactcagccaccctcggcgtcagtggccccaggacagacggccacgattacctgtgagggaaactacattgaaaggaaaagtgtccattggtatcagcagaagccaggccaggcccctgtgctggtcctccatgatgatagcgaccggccctcagggatccctgagggattctccggctccaactctgggaacacggccaccctgaccatcagcagggtcgaagccggagatgaggccgactattactgtcaggtgtgggatcgtgatagtgaccattgggtgttcggcggagggaccaagttgaccgtcctaagtcagcccaaggctgccccctcggtcactctgttcccgcctcctcta

SEQ ID NO: 576007 - DNA, 496 bp, Homo sapiens
  misc_feature: HIJSMM301BECWJ.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcgaggggtttctaatcgcttctctggctccaagtctggcaacacggcctccctgaccatctctgggctccaggctgaggacgaggctgattattactgcagctcatatacaagcagcagcactctcgtggtattcggcggaggaccaagctgaccgtcctaggtcagcccaa

SEQ ID NO: 576008 - DNA, 498 bp, Homo sapiens
  misc_feature: HIJSMM301DWT86.21.8.A08.1.454.light.4.raw
tcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgactactattgttacgcaccagacagtagtggtcatcagggggtattcggcggagggaccaagttgaccgtcttggtcagcccaaggctcgccccctggtcactctcg

SEQ ID NO: 576009 - DNA, 506 bp, Homo sapiens; identical to SEQ ID NO: 549591
  misc_feature: HIJSMM301BVQGI.17.87.H10.1.454.light.4.raw

SEQ ID NO: 576010 - DNA, 506 bp, Homo sapiens; identical to SEQ ID NO: 554661
  misc_feature: HIJSMM301EGJKA.3.79.H02.1.454.light.4.raw

SEQ ID NO: 576011 - DNA, 486 bp, Homo sapiens; identical to SEQ ID NO: 541357
  misc_feature: HIJSMM301CMLMP.17.26.C04.1.454.light.4.raw

SEQ ID NO: 576012 - DNA, 486 bp, Homo sapiens
  misc_feature: HIJSMM301ET3VO.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtcac

SEQ ID NO: 576013 - DNA, 444 bp, Homo sapiens; identical to SEQ ID NO: 535192
  misc_feature: HIJSMM301AQ8JJ.5.9.A09.1.454.light.4.raw

SEQ ID NO: 576014 - DNA, 491 bp, Homo sapiens; identical to SEQ ID NO: 535294
  misc_feature: HIJSMM301AYJ3Y.16.68.G02.1.454.light.4.raw

SEQ ID NO: 576015 - DNA, 497 bp, Homo sapiens; identical to SEQ ID NO: 555392
  misc_feature: HIJSMM301ALHSU.43.71.G05.1.454.light.4.raw

SEQ ID NO: 576016 - DNA, 504 bp, Homo sapiens
  misc_feature: HIJSMM301AG487.48.61.F06.1.454.light.4.raw
agtatacatacacgaccggtgctcgatttagctacgctctaagggaaaggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 576017 - DNA, 482 bp, Homo sapiens; identical to SEQ ID NO: 544520
  misc_feature: HIJSMM301EEEKS.49.28.C06.1.454.light.4.raw

SEQ ID NO: 576018 - DNA, 486 bp, Homo sapiens; identical to SEQ ID NO: 535043
  misc_feature: HIJSMM301CLOLY.46.35.D02.1.454.light.4.raw

SEQ ID NO: 576019 - DNA, 500 bp, Homo sapiens
  misc_feature: HIJSMM301C9Z9V.7.59.F04.1.454.light.4.raw
  modified_base (488)..(488): a, c, t, g, unknown or other
cgtgtctctacacgaccggtgctcgatttagtacacacacttagggattggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattaactgccaacagtataagagttatccgtggacgtgtccgacggaccgaggtggaagtacaaacgaacctaagtggcgtgcaccacnctgtcttctatt

SEQ ID NO: 576020 - DNA, 492 bp, Homo sapiens
  misc_feature: HIJSMM301BXOTN.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtcctcagtcagcccg

SEQ ID NO: 576021 - DNA, 441 bp, Homo sapiens; identical to SEQ ID NO: 534971
  misc_feature: HIJSMM301A154Y.11.3.A03.1.454.light.4.raw

SEQ ID NO: 576022 - DNA, 494 bp, Homo sapiens; identical to SEQ ID NO: 534992
  misc_feature: HIJSMM301CTJRP.9.1.A01.1.454.light.4.raw

SEQ ID NO: 576023 - DNA, 495 bp, Homo sapiens; identical to SEQ ID NO: 557386
  misc_feature: HIJSMM301DY3DV.27.78.H01.1.454.light.4.raw

SEQ ID NO: 576024 - DNA, 503 bp, Homo sapiens; identical to SEQ ID NO: 547049
  misc_feature: HIJSMM301AJS12.18.59.F04.1.454.light.4.raw

SEQ ID NO: 576025 - DNA, 491 bp, Homo sapiens
  misc_feature: HIJSMM301DEX5U.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtctaggtcagcccaaggccaacccactgtcactctcg

SEQ ID NO: 576026 - DNA, 441 bp, Homo sapiens; identical to SEQ ID NO: 534971
  misc_feature: HIJSMM301D8JD5.11.3.A03.1.454.light.4.raw

SEQ ID NO: 576027 - DNA, 501 bp, Homo sapiens
  misc_feature: HIJSMM301EAQIA.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgccagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgtt

SEQ ID NO: 576028 - DNA, 484 bp, Homo sapiens
  misc_feature: HIJSMM301AFJGE.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggtcggagggaccgaaggtggagatacaaacgaaactgtgggctgcaccactactgtt

SEQ ID NO: 576029 - DNA, 494 bp, Homo sapiens; identical to SEQ ID NO: 536444
  misc_feature: HIJSMM301BEYJD.26.72.G06.1.454.light.4.raw

SEQ ID NO: 576030 - DNA, 494 bp, Homo sapiens; identical to SEQ ID NO: 534994
  misc_feature: HIJSMM301DRX5O.27.78.H01.1.454.light.4.raw

SEQ ID NO: 576031 - DNA, 494 bp, Homo sapiens
  misc_feature: HIJSMM301C110J.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcggggggaccaaggtggagatcaaacgaactgtggctgcaccatctgtt

SEQ ID NO: 576032 - DNA, 492 bp, Homo sapiens
  misc_feature: HIJSMM301DMNTY.52.52.E08.1.454.light.4.raw
cgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggtttcagcagaggccaggccaatctccaaggcgcctaatttataaggtttctcaccgggactctggggtcccagacagattcagcggcagtgggtcaggcactgatttcacgctgaaaatcagcagggtggaggctgaagatgttggggtttattactgcatgcaaggcacacactggcctgcgtacacttttggccaggggaccaagctggacgaggaacgaactgt

SEQ ID NO: 576033 - DNA, 497 bp, Homo sapiens
  misc_feature: HIJSMM301AY1NJ.40.44.D11.1.454.light.4.raw
tctagcgactcacgaccggtgctcgatttagcgcagtacgaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaacagcaacttagcctggtaccaacaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgcc

SEQ ID NO: 576034 - DNA, 501 bp, Homo sapiens; identical to SEQ ID NO: 537690
  misc_feature: HIJSMM301BXCAY.41.14.B03.1.454.light.4.raw

SEQ ID NO: 576035 - DNA, 500 bp, Homo sapiens
  misc_feature: HIJSMM301CP048.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccaggccaggttcagtggcagtgggtctgggacagagttcactctcaccatcagcagcctgcagtctgaagattttgcagtttattactgtcagcagtataattactggcctcggacgttcggccgaacgggaccgaacggtaggaagtacgaaacgaactagtggctgcaccatctgtctt

SEQ ID NO: 576036 - DNA, 483 bp, Homo sapiens
  misc_feature: HIJSMM301CK00E.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctatcactgtcagcagtatggtcacgtcccaagaactttggccaggggaccaagctggagatcaaacgaactgtggctgcacc

SEQ ID NO: 576037 - DNA, 506 bp, Homo sapiens; identical to SEQ ID NO: 564138
  misc_feature: HIJSMM301CU10G.9.12.B01.1.454.light.4.raw

SEQ ID NO: 576038 - DNA, 441 bp, Homo sapiens; identical to SEQ ID NO: 534971
  misc_feature: HIJSMM301AR6N2.11.3.A03.1.454.light.4.raw

SEQ ID NO: 576039 - DNA, 467 bp, Homo sapiens; identical to SEQ ID NO: 535997
  misc_feature: HIJSMM301BWL00.5.36.D03.1.454.light.4.raw

SEQ ID NO: 576040 - DNA, 505 bp, Homo sapiens
  misc_feature: HIJSMM301D7JPI.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgtcggccaaggaccaaggtggaagtcaagcgaactgtggctgcaccatctgtcttcatcttccgcc

SEQ ID NO: 576041 - DNA, 491 bp, Homo sapiens; identical to SEQ ID NO: 545038
  misc_feature: HIJSMM301ESN12.22.25.C03.1.454.light.4.raw

SEQ ID NO: 576042 - DNA, 503 bp, Homo sapiens; identical to SEQ ID NO: 547049
  misc_feature: HIJSMM301C3PWN.18.59.F04.1.454.light.4.raw

SEQ ID NO: 576043 - DNA, 494 bp, Homo sapiens; identical to SEQ ID NO: 562936
  misc_feature: HIJSMM301BPEB4.10.60.F05.1.454.light.4.raw

SEQ ID NO: 576044 - DNA, 484 bp, Homo sapiens; identical to SEQ ID NO: 535240
  misc_feature: HIJSMM301EIG1D.47.60.F05.1.454.light.4.raw

SEQ ID NO: 576045 - DNA, 503 bp, Homo sapiens
  misc_feature: HIJSMM301AXU72.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctggtcact

SEQ ID NO: 576046 - DNA, 499 bp, Homo sapiens
  misc_feature: HIJSMM301DQMPF.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctcgttccc

SEQ ID NO: 576047 - DNA, 488 bp, Homo sapiens; identical to SEQ ID NO: 538811
  misc_feature: HIJSMM301AHKZX.40.83.H06.1.454.light.4.raw

SEQ ID NO: 576048 - DNA, 496 bp, Homo sapiens
  misc_feature: HIJSMM301BB5DY.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagagtcaaacgaactgtggctgcaccatctgtctt

SEQ ID NO: 576049 - DNA, 500 bp, Homo sapiens; identical to SEQ ID NO: 549217
  misc_feature: HIJSMM301B3E0F.4.71.G05.1.454.light.4.raw

SEQ ID NO: 576050 - DNA, 492 bp, Homo sapiens
  misc_feature: HIJSMM301ECEJ7.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatct

SEQ ID NO: 576051 - DNA, 518 bp, Homo sapiens
  misc_feature: HIJSMM301BQE61.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggcccaaccccactgtcactctgttcccgccctcctccgt

SEQ ID NO: 576052 - DNA, 491 bp, Homo sapiens
  misc_feature: HIJSMM301BF34Q.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgctacttttggccaggggaccaaagttgagatacaaacgaactgtggctgcaccatctgtt

SEQ ID NO: 576053 - DNA, 512 bp, Homo sapiens
  misc_feature: HIJSMM301D2UOE.12.55.E11.1.454.light.4.raw
atacgacgtacacgaccggtgctcgatttagcactcgcacgttgggtttgggggtggtagctcaggaagcagagcctggagcatctccactaaatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgctttgttttttcggtcggtcgggaccaagctgaccgtcctaggtcagcccaaggctgccccctcggtccta

SEQ ID NO: 576054 - DNA, 510 bp, Homo sapiens
  misc_feature: HIJSMM301EKBG6.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggtcggacgggaccgaacggtaggaggatacaaacgaacctagtggcgtgcgaccaactctgtcttctatt

SEQ ID NO: 576055 - DNA, 493 bp, Homo sapiens
  misc_feature: HIJSMM301DGU5L.51.76.G10.1.454.light.4.raw
cgatcgtatacacgaccggtgctcgatttagtcactcatacaggggagagctctggggaggaactgctcagttaggacccagacggaaccatggaagccccagcgcagcttctcttcctcctgctactctggctcccagataccactggagaagtagtgatgacgcagtctccagccaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagtattttgcagtttattattgtcagcagcgaaacaactggcctccttggacgttcggccaagggaccaaggtaggaaatcaaacgaactgtggctgcacc

SEQ ID NO: 576056 - DNA, 505 bp, Homo sapiens
  misc_feature: HIJSMM301CR4ZZ.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaacgaactgtggctgcaccatctgtt

SEQ ID NO: 576057 - DNA, 496 bp, Homo sapiens
  misc_feature: HIJSMM301DR69G.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttcccgt

SEQ ID NO: 576058 - DNA, 503 bp, Homo sapiens; identical to SEQ ID NO: 538884
  misc_feature: HIJSMM301A2K2U.27.78.H01.1.454.light.4.raw

SEQ ID NO: 576059 - DNA, 503 bp, Homo sapiens
  misc_feature: HIJSMM301BREB3.48.71.G05.1.454.light.4.raw
agtatacatacacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggcaggggaccaaggtggaaatcaaacgaactgtggctgcaccatctgtcttcatcttcccg

SEQ ID NO: 576060 - DNA, 499 bp, Homo sapiens; identical to SEQ ID NO: 536578
  misc_feature: HIJSMM301AMVND.22.27.C05.1.454.light.4.raw

SEQ ID NO: 576061 - DNA, 501 bp, Homo sapiens; identical to SEQ ID NO: 535873
  misc_feature: HIJSMM301CR6DU.17.27.C05.1.454.light.4.raw

SEQ ID NO: 576062 - DNA, 501 bp, Homo sapiens; identical to SEQ ID NO: 536867
  misc_feature: HIJSMM301B9Q13.5.86.H09.1.454.light.4.raw

SEQ ID NO: 576063 - DNA, 523 bp, Homo sapiens
  misc_feature: HIJSMM301C79N4.48.57.F02.1.454.light.4.raw
agtatacatacacgaccggtgctcgatttagctcgatatagttgggtttggggggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagccaaggcctgccccctcggtcactctgttcccaccctcctcta

SEQ ID NO: 576064 - DNA, 494 bp, Homo sapiens; identical to SEQ ID NO: 534994
  misc_feature: HIJSMM301CWGU4.27.78.H01.1.454.light.4.raw

SEQ ID NO: 576065 - DNA, 520 bp, Homo sapiens
  misc_feature: HIJSMM301BWOV6.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggccaacccactgtcactctgttcccaccctcctccgtcg

SEQ ID NO: 576066 - DNA, 509 bp, Homo sapiens; identical to SEQ ID NO: 539359
  misc_feature: HIJSMM301A5AJJ.47.85.H08.1.454.light.4.raw

SEQ ID NO: 576067 - DNA, 498 bp, Homo sapiens
  misc_feature: HIJSMM301AQ0MK.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcctaaaacctttcggtcggagggaccgaaggacggagatcagacgaactgtggctgcaccatctgtcttcta

SEQ ID NO: 576068 - DNA, 495 bp, Homo sapiens; identical to SEQ ID NO: 535821
  misc_feature: HIJSMM301A1LCS.3.31.C09.1.454.light.4.raw

SEQ ID NO: 576069 - DNA, 501 bp, Homo sapiens; identical to SEQ ID NO: 548482
  misc_feature: HIJSMM301B3LP2.41.71.G05.1.454.light.4.raw

SEQ ID NO: 576070 - DNA, 496 bp, Homo sapiens
  misc_feature: HIJSMM301CZARX.9.39.D06.1.454.light.4.raw
tgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagattttgcagtttactattgtcagcagtatagtaacggccgctcactttcggcggagggaccaaggtggagatcaaacgaactgtggctgcaccatctgtcttcta

SEQ ID NO: 576071 - DNA, 492 bp, Homo sapiens; identical to SEQ ID NO: 535939
  misc_feature: HIJSMM301BTXGC.13.5.A05.1.454.light.4.raw

SEQ ID NO: 576072 - DNA, 498 bp, Homo sapiens; identical to SEQ ID NO: 537020
  misc_feature: HIJSMM301EUQR1.26.26.C04.1.454.light.4.raw

SEQ ID NO: 576073 - DNA, 487 bp, Homo sapiens
  misc_feature: HIJSMM301AGSJC.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgctactttattactgtcagcaatataatgactggttctcgatcaccttcggccaagggacacgactggagattaaacgaactgtggctgcaccatctgt

SEQ ID NO: 576074 - DNA, 504 bp, Homo sapiens; identical to SEQ ID NO: 538940
  misc_feature: HIJSMM301ATQ1C.2.35.D02.1.454.light.4.raw

SEQ ID NO: 576075 - DNA, 488 bp, Homo sapiens; identical to SEQ ID NO: 543444
  misc_feature: HIJSMM301B9G8O.51.29.C07.1.454.light.4.raw

SEQ ID NO: 576076 - DNA, 498 bp, Homo sapiens
  misc_feature: HIJSMM301AN4SO.49.9.A09.1.454.light.4.raw
agtcgagagacacgaccggtgctcgatttagcgagacgcgcagggcacgaccggtgctcgatttagagctcacgtattgggtttggggggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctgg

SEQ ID NO: 576077 - DNA, 487 bp, Homo sapiens
  misc_feature: HIJSMM301AE8GL.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtgctgcaccat

SEQ ID NO: 576078 - DNA, 491 bp, Homo sapiens
  misc_feature: HIJSMM301DENZK.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcggggggaccgaaaggtaggacgtacaaacgaaactgtggctgcaccaa

SEQ ID NO: 576079 - DNA, 506 bp, Homo sapiens
  misc_feature: HIJSMM301BS3BO.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtaggctgcaccatctgtcttcatcttcccgccat

SEQ ID NO: 576080 - DNA, 499 bp, Homo sapiens; identical to SEQ ID NO: 537739
  misc_feature: HIJSMM301D621W.12.86.H09.1.454.light.4.raw

SEQ ID NO: 576081 - DNA, 506 bp, Homo sapiens; identical to SEQ ID NO: 557726
  misc_feature: HIJSMM301AGETK.47.83.H06.1.454.light.4.raw

SEQ ID NO: 576082 - DNA, 505 bp, Homo sapiens
  misc_feature: HIJSMM301D9PZB.49.80.H03.1.454.light.4.raw
agtcgagagacacgaccggtgctcgatttagctgtgcgtcgaagggaaagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggaccagacttcactctcaccatcagcagcctagagcctgaagactttgcagtttattactgtcagcagcgtagcaatttgatcaccttcggccaagggacacgactggaaattaaacgaactgtggctgcaccatctgtcttcatcttcccgccta

SEQ ID NO: 576083 - DNA, 490 bp, Homo sapiens
  misc_feature: HIJSMM301DAHH3.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtactcccagccaggttcagtggcagtgggtctgggacagagttcattctcaccatcagcagcctgcagtctgaagattttgctaatttattactgtcagcagtataataactggtggacgttcggccaagggaccaaggtagaaatacaaacgaactgtggctgcaccatctgt

SEQ ID NO: 576084 - DNA, 489 bp, Homo sapiens
  misc_feature: HIJSMM301ESG6V.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcattataataactggtggacgttcggccaagggaccaaggtagaaatacaaaacgaactgtggctgcaccatctgt

SEQ ID NO: 576085 - DNA, 488 bp, Homo sapiens
  misc_feature: HIJSMM301BTPIO.15.67.G01.1.454.light.4.raw
  modified_base (405)..(405): a, c, t, g, unknown or other
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttnttactgtctacaagattacaattaccctcgacgttcggtccagggaccgaaggtggaagtacaacgaaactgtggctgcacca

SEQ ID NO: 576086 - DNA, 504 bp, Homo sapiens
  misc_feature: HIJSMM301DUVG4.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatacaaaggaactgtggctgcaccatctgtcttcatcttcccgtcca

SEQ ID NO: 576087 - DNA, 509 bp, Homo sapiens; identical to SEQ ID NO: 542468
  misc_feature: HIJSMM301BPHNU.8.33.C11.1.454.light.4.raw

SEQ ID NO: 576088 - DNA, 467 bp, Homo sapiens; identical to SEQ ID NO: 541349
  misc_feature: HIJSMM301AYYVN.4.75.G09.1.454.light.4.raw

SEQ ID NO: 576089 - DNA, 454 bp, Homo sapiens; identical to SEQ ID NO: 534964
  misc_feature: HIJSMM301CZLDV.19.86.H09.1.454.light.4.raw

SEQ ID NO: 576090 - DNA, 513 bp, Homo sapiens
  misc_feature: HIJSMM301DTKSO.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaacccactgtcactctgttcccaccctcctcga

SEQ ID NO: 576091 - DNA, 502 bp, Homo sapiens; identical to SEQ ID NO: 544444
  misc_feature: HIJSMM301AGW86.5.24.C02.1.454.light.4.raw

SEQ ID NO: 576092 - DNA, 496 bp, Homo sapiens
  misc_feature: HIJSMM301A3M1W.52.60.F05.1.454.light.4.raw
cgcagtacgacacgaccggtgctcgatttagtacgtcatcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactggaccaaggtcaccgtcctaggtcagcccaaggcccaacccgactcgtca

SEQ ID NO: 576093 - DNA, 475 bp, Homo sapiens
  misc_feature: HIJSMM301BOT9J.5.70.G04.1.454.light.4.raw
atcagacacgcacgaccggtgctcgatttagtgtagtgtgaagggaaaggggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactgtgg

SEQ ID NO: 576094 - DNA, 484 bp, Homo sapiens; identical to SEQ ID NO: 535441
  misc_feature: HIJSMM301BPCFM.26.60.F05.1.454.light.4.raw

SEQ ID NO: 576095 - DNA, 491 bp, Homo sapiens; identical to SEQ ID NO: 535294
  misc_feature: HIJSMM301BX2R9.16.68.G02.1.454.light.4.raw

SEQ ID NO: 576096 - DNA, 495 bp, Homo sapiens
  misc_feature: HIJSMM301BSJDZ.10.25.C03.1.454.light.4.raw
catagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctgggacagagttcgctctcaccatcagcagtctgcagtctgaagattttgcagtttattactgtcaggaatatgatggctggcctccgtacacttttggccaagggaccaagttggacatcaacgaactgtggctgca

SEQ ID NO: 576097 - DNA, 503 bp, Homo sapiens
  misc_feature: HIJSMM301B7JYT.10.29.C07.1.454.light.4.raw
catagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtccaggtcagcccaaggctgccccctggtcca

SEQ ID NO: 576098 - DNA, 499 bp, Homo sapiens; identical to SEQ ID NO: 536578
  misc_feature: HIJSMM301EH5Z3.22.27.C05.1.454.light.4.raw

SEQ ID NO: 576099 - DNA, 490 bp, Homo sapiens; identical to SEQ ID NO: 541567
  misc_feature: HIJSMM301EZ3N0.22.65.F10.1.454.light.4.raw

SEQ ID NO: 576100 - DNA, 514 bp, Homo sapiens; identical to SEQ ID NO: 541418
  misc_feature: HIJSMM301BULBH.17.33.C11.1.454.light.4.raw

SEQ ID NO: 576101 - DNA, 506 bp, Homo sapiens
  misc_feature: HIJSMM301EU0D0.40.28.C06.1.454.light.4.raw
tctagcgactcacgaccggtgctcgatttagagctcacgtattgggtttgggggaagagcttctcagttaggacccagagggaaccatggaaaccccagcgcagcttctcttcctcctgctactctggctcccagatgccaccggagaaattgtgttgacgcagtctccaggtaccctgtctttgtctccaggggaaagagccaccctctcctgcagggccagtcagagtattaggaacactgtccaaggctggtatcagcataaacctggccaggctcccaggctcctcatctatgagacgtccaggagggccagtggcatcccagacaggttcagtggcagtgggtctgggaccgacttcactctaaccatcagtagactggaacctgaagactctgcagtgtattactgtcaacactttgaaggcccacttatcacattcggcggagggaccaaggtggagatcaagcgaactgtggctgcaccatctgtcttcatcttcccg

SEQ ID NO: 576102 - DNA, 498 bp, Homo sapiens; identical to SEQ ID NO: 552428
  misc_feature: HIJSMM301AFYBC.10.65.F10.1.454.light.4.raw

SEQ ID NO: 576103 - DNA, 488 bp, Homo sapiens
  misc_feature: HIJSMM301EBE79.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttatactgtcaacaatattataataatccatttaattcggcggagggaccaaggtggagatcaaacgaactgtggctgcaccatctgtcttcatcttcccgcc

SEQ ID NO: 576104 - DNA, 486 bp, Homo sapiens; identical to SEQ ID NO: 535043
  misc_feature: HIJSMM301CF1KA.46.35.D02.1.454.light.4.raw

SEQ ID NO: 576105 - DNA, 496 bp, Homo sapiens
  misc_feature: HIJSMM301ERPHQ.43.77.G11.1.454.light.4.raw
tgtgagtagtcacgaccggtgctcgatttagctagtcactcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgttcaggcgtgggacaccaacactgtggttttcggcggagggaccaaggctgaccgtcctaggtcagcccaaggctgccccctcggtcta

SEQ ID NO: 576106 - DNA, 485 bp, Homo sapiens; identical to SEQ ID NO: 536075
  misc_feature: HIJSMM301CTAQY.17.21.B10.1.454.light.4.raw

SEQ ID NO: 576107 - DNA, 510 bp, Homo sapiens
  misc_feature: HIJSMM301CQK30.15.59.F04.1.454.light.4.raw
tctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctgggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggctattttcggtcttcggcggagggaccaagctgaccgtcctaggtcagcccaaggctcgccccctggt

SEQ ID NO: 576108 - DNA, 473 bp, Homo sapiens
  misc_feature: HIJSMM301EQVYF.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcacgtcctaagtcacg

SEQ ID NO: 576109 - DNA, 491 bp, Homo sapiens
  misc_feature: HIJSMM301EFWUI.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaaacagagttacagtacccccctcactttcggcggagggaccaaaggcggagaatcagacaactgtggctgcaccatctgtcttcta

SEQ ID NO: 576110 - DNA, 493 bp, Homo sapiens
  misc_feature: HIJSMM301A8H8R.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccagggtggagatcaaacgaactgtggctgcaccatctgtcttcat

SEQ ID NO: 576111 - DNA, 373 bp, Homo sapiens
  misc_feature: HIJSMM301BIFLP.11.60.F05.1.454.light.4.raw
cgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttctcgccatctgagtatctctcg

SEQ ID NO: 576112 - DNA, 494 bp, Homo sapiens
  misc_feature: HIJSMM301ECN8J.10.77.G11.1.454.light.4.raw
  modified_base (462)..(462): a, c, t, g, unknown or other
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacgagggccactggcatcccagccaggttcagtggcagtgggtctgggacagacttcactctcaccatcagcagactagagcctgaagtattttgctagtttattactgtcagcagcgtagcaactggcctcggacgttcgcgaaggacgaagtagganatacaagacgaactgtggctgcacactctgtt

SEQ ID NO: 576113 - DNA, 494 bp, Homo sapiens
  misc_feature: HIJSMM301C4SQG.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctcgtcttcatt

SEQ ID NO: 576114 - DNA, 491 bp, Homo sapiens
  misc_feature: HIJSMM301AXEQ6.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccaacaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccgccctcctctacgtgagct

SEQ ID NO: 576115 - DNA, 496 bp, Homo sapiens
  misc_feature: HIJSMM301DZV3J.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagactggagatcaaacgaactgtggcg

SEQ ID NO: 576116 - DNA, 463 bp, Homo sapiens; identical to SEQ ID NO: 535062
  misc_feature: HIJSMM301D3P6L.11.73.G07.1.454.light.4.raw

SEQ ID NO: 576117 - DNA, 517 bp, Homo sapiens
  misc_feature: HIJSMM301BSBJ4.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgcccctcggtcactctgttccacct

SEQ ID NO: 576118 - DNA, 500 bp, Homo sapiens
  misc_feature: HIJSMM301CFCVG.43.53.E09.1.454.light.4.raw
tgtgagtagtcacgaccggtgctcgatttagagagagtgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 576119 - DNA, 508 bp, Homo sapiens
  misc_feature: HIJSMM301ATOL3.48.34.D01.1.454.light.4.raw
  modified_base (477)..(477): a, c, t, g, unknown or other
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcngcccaaggctgccccctccggtcactctgtt

SEQ ID NO: 576120 - DNA, 489 bp, Homo sapiens
  misc_feature: HIJSMM301CCZ9F.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcacatctgt

SEQ ID NO: 576121 - DNA, 510 bp, Homo sapiens
  misc_feature: HIJSMM301ESGOU.10.71.G05.1.454.light.4.raw
catagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaatagaggtcgaaacgaactgtggctgcaccatctgtcttcatcttccccg

SEQ ID NO: 576122 - DNA, 502 bp, Homo sapiens; identical to SEQ ID NO: 540196
  misc_feature: HIJSMM301AGIXY.40.45.E01.1.454.light.4.raw

SEQ ID NO: 576123 - DNA, 509 bp, Homo sapiens
  misc_feature: HIJSMM301D6YLG.17.33.C11.1.454.light.4.raw
  modified_base (467)..(467): a, c, t, g, unknown or other
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtnttaagtcagcccaaggctgccccctcggtcactctgttcccg

SEQ ID NO: 576124 - DNA, 494 bp, Homo sapiens
  misc_feature: HIJSMM301EHX9M.51.81.H04.1.454.light.4.raw
cgatcgtatacacgaccggtgctcgatttagtagtgtagattcgcggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgaagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 576125 - DNA, 500 bp, Homo sapiens
  misc_feature: HIJSMM301CCP0N.48.82.H05.1.454.light.4.raw
agtatacatacacgaccggtgctcgatttagtcgagctctctcgcggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggccaagctgaccgtcctaggtcagcccaaggctgccccctc

SEQ ID NO: 576126 - DNA, 501 bp, Homo sapiens; identical to SEQ ID NO: 536867
  misc_feature: HIJSMM301BWYZB.5.86.H09.1.454.light.4.raw

SEQ ID NO: 576127 - DNA, 512 bp, Homo sapiens
  misc_feature: HIJSMM301APASJ.17.33.C11.1.454.light.4.raw
cgtagactagcacgaccggtgctcgatttagagtgagctcgttgggtttgggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactcttactttggtggtgctgtgctattcggcggagggaccaagctgaccgtcttaagtcagcccaaggctcgccccctcggtcactctgttcccta

SEQ ID NO: 576128 - DNA, 513 bp, Homo sapiens
  misc_feature: HIJSMM301ELJJT.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagccaaggctgccccctcggtcactctcgttcccgccctcctcta

SEQ ID NO: 576129 - DNA, 488 bp, Homo sapiens; identical to SEQ ID NO: 536861
  misc_feature: HIJSMM301BJS75.12.88.H11.1.454.light.4.raw

SEQ ID NO: 576130 - DNA, 505 bp, Homo sapiens; identical to SEQ ID NO: 550196
  misc_feature: HIJSMM301CI19Q.10.27.C05.1.454.light.4.raw

SEQ ID NO: 576131 - DNA, 490 bp, Homo sapiens; identical to SEQ ID NO: 538999
  misc_feature: HIJSMM301ENZUM.16.86.H09.1.454.light.4.raw

SEQ ID NO: 576132 - DNA, 503 bp, Homo sapiens; identical to SEQ ID NO: 541454
  misc_feature: HIJSMM301BWG35.9.12.B01.1.454.light.4.raw

SEQ ID NO: 576133 - DNA, 508 bp, Homo sapiens; identical to SEQ ID NO: 536062
  misc_feature: HIJSMM301DDBDW.11.57.F02.1.454.light.4.raw

SEQ ID NO: 576134 - DNA, 484 bp, Homo sapiens
  misc_feature: HIJSMM301D8JLJ.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagtaccagggccaccctcccaagctcctctccgacaggaataacatccggccctcagggatctcagagagattctctgcatccaggtcaggaagcacagcctccctgaccattactggactccaggctgacgacgaagctgattattactgctcagcatggacaccggcctcagtgcgtgggttttcggcggagggaccaagctgaccgtcctaggtcagcccaac

SEQ ID NO: 576135 - DNA, 497 bp, Homo sapiens
  misc_feature: HIJSMM301AHLTX.40.34.D01.1.454.light.4.raw
tctagcgactcacgaccggtgctcgatttagatcgtctgtgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgacatctctgggctccagactgaggatgaggctacttattttgctgctcttatgcaggcagtttcgctctcgaagtgttcggcggagggaccgagctgaccgtcctacgtcagcccaaggctccg

SEQ ID NO: 576136 - DNA, 447 bp, Homo sapiens; identical to SEQ ID NO: 535201
  misc_feature: HIJSMM301C8IK4.18.9.A09.1.454.light.4.raw

SEQ ID NO: 576137 - DNA, 504 bp, Homo sapiens
  misc_feature: HIJSMM301BG2ET.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccactgtcta

SEQ ID NO: 576138 - DNA, 447 bp, Homo sapiens; identical to SEQ ID NO: 541817
  misc_feature: HIJSMM301C7O1P.18.9.A09.1.454.light.4.raw

SEQ ID NO: 576139 - DNA, 508 bp, Homo sapiens
  misc_feature: HIJSMM301B4V0X.7.5.A05.1.454.light.4.raw
  modified_base (314)..(314): a, c, t, g, unknown or other
  modified_base (462)..(462): a, c, t, g, unknown or other
  modified_base (482)..(482): a, c, t, g, unknown or other
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttnaggggtttccaatcgcttctctggctccaagtctggcgacacggcctccctgaccatctctgggctccaggctgaagacgaggctgattatttactgcagctcatattacaggcagcagcactcaggttttcggcgggagggaccaanactgaccgtccgtaacggtnacgcccaacggctcgcccccttcggt

SEQ ID NO: 576140 - DNA, 520 bp, Homo sapiens; identical to SEQ ID NO: 567561
  misc_feature: HIJSMM301E3IH6.27.23.C01.1.454.light.4.raw

SEQ ID NO: 576141 - DNA, 497 bp, Homo sapiens
  misc_feature: HIJSMM301CFJDY.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagaccgttcggccaagggaccaaggtggaaatcaaacgaactgtggctgcacc

SEQ ID NO: 576142 - DNA, 519 bp, Homo sapiens
  misc_feature: HIJSMM301CL63E.27.23.C01.1.454.light.4.raw
  modified_base (509)..(509): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccaggctgaccgtcctaggtcagcccaaggctgccccctcggtcactcngttcccacct

SEQ ID NO: 576143 - DNA, 544 bp, Homo sapiens
  misc_feature: HIJSMM301AE838.15.78.H01.1.454.light.4.raw
tctacgtagccacgaccggtgctcgatttagtgtgagtagtttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagcccccgtttcatcttcccgccatctgag

SEQ ID NO: 576144 - DNA, 501 bp, Homo sapiens; identical to SEQ ID NO: 542488
  misc_feature: HIJSMM301D4G7J.19.78.H01.1.454.light.4.raw

SEQ ID NO: 576145 - DNA, 513 bp, Homo sapiens
  misc_feature: HIJSMM301A81OW.13.3.A03.1.454.light.4.raw
tcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttacttgttgttcatatgcaggaaggagtgattatgtctttggaagtgggaccaaggtcaccgtccttggtcagcccaaggccaacccccactgtcactctgttcccta

SEQ ID NO: 576146 - DNA, 496 bp, Homo sapiens
  misc_feature: HIJSMM301DJO77.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagtattttgctagtttattactgtcagcagtataataactggttcctgctcacgtttcggcgggggaccaaggtggagatcaaacgaactgtggctgcaccatctgtt

SEQ ID NO: 576147 - DNA, 488 bp, Homo sapiens; identical to SEQ ID NO: 537260
  misc_feature: HIJSMM301CSNE6.47.70.G04.1.454.light.4.raw

SEQ ID NO: 576148 - DNA, 494 bp, Homo sapiens; identical to SEQ ID NO: 535828
  misc_feature: HIJSMM301DDFDL.3.36.D03.1.454.light.4.raw

SEQ ID NO: 576149 - DNA, 481 bp, Homo sapiens
  misc_feature: HIJSMM301EUECE.51.53.E09.1.454.light.4.raw
cgatcgtatacacgaccggtgctcgatttagagagagtgtgttgggtttggggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccaaggtggagatcaagcgaactgtggctgcaccatctgtt

SEQ ID NO: 576150 - DNA, 481 bp, Homo sapiens
  misc_feature: HIJSMM301D5E4L.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagatttgcaacttactactgtcaacagagtttcactacccctctcactttcggcgggggaccaaggtggagatcaaacgaactgtggctgcacca

SEQ ID NO: 576151 - DNA, 503 bp, Homo sapiens; identical to SEQ ID NO: 547049
  misc_feature: HIJSMM301B1J8M.18.59.F04.1.454.light.4.raw

SEQ ID NO: 576152 - DNA, 485 bp, Homo sapiens
  misc_feature: HIJSMM301BOEUA.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagatgccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtgg

SEQ ID NO: 576153 - DNA, 484 bp, Homo sapiens; identical to SEQ ID NO: 535441
  misc_feature: HIJSMM301DN6F8.26.60.F05.1.454.light.4.raw

SEQ ID NO: 576154 - DNA, 506 bp, Homo sapiens
  misc_feature: HIJSMM301BBIR8.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtgccaggaccgaaggaggagtacaaacgaacagtggcgtgcaccatctgtcttctatcttcccgtcccact

SEQ ID NO: 576155 - DNA, 495 bp, Homo sapiens
  misc_feature: HIJSMM301ENTC9.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaatcaaacgaactgtggctgcaccatctgtctt

SEQ ID NO: 576156 - DNA, 496 bp, Homo sapiens; identical to SEQ ID NO: 537925
  misc_feature: HIJSMM301BPM20.22.14.B03.1.454.light.4.raw

SEQ ID NO: 576157 - DNA, 517 bp, Homo sapiens
  misc_feature: HIJSMM301EPZ9U.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcaagccggggatgaggccgactattactgtcaggtgtggaatggtgattatgattatgtcttcggaactgggaccaaggtcacgtcctaggtcagcccaaggccaaccccactgtcactctgttcccaccctcctccgtgt

SEQ ID NO: 576158 - DNA, 507 bp, Homo sapiens
  misc_feature: HIJSMM301BTX4C.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctcgggaccaaagtggagtatcaaacgaactagtggctgcaccatctgtctt

SEQ ID NO: 576159 - DNA, 485 bp, Homo sapiens; identical to SEQ ID NO: 536872
  misc_feature: HIJSMM301EKBGP.26.23.C01.1.454.light.4.raw

SEQ ID NO: 576160 - DNA, 498 bp, Homo sapiens; identical to SEQ ID NO: 537020
  misc_feature: HIJSMM301AW8HG.26.26.C04.1.454.light.4.raw

SEQ ID NO: 576161 - DNA, 491 bp, Homo sapiens
  misc_feature: HIJSMM301BXBS0.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctgaccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgactagtggctgcaccatcttcg

SEQ ID NO: 576162 - DNA, 496 bp, Homo sapiens; identical to SEQ ID NO: 538625
  misc_feature: HIJSMM301EKXI7.2.49.E05.1.454.light.4.raw

SEQ ID NO: 576163 - DNA, 499 bp, Homo sapiens
  misc_feature: HIJSMM301DBXI4.40.43.D10.1.454.light.4.raw
tctagcgactcacgaccggtgctcgatttagactagcagtaagggggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcggccaacggaccaaggtggacatcaagcgaactgtggctgcaccatctgtcttcatcttcccgtcccat

SEQ ID NO: 576164 - DNA, 511 bp, Homo sapiens; identical to SEQ ID NO: 548439
  misc_feature: HIJSMM301ECH7M.16.46.E02.1.454.light.4.raw

SEQ ID NO: 576165 - DNA, 509 bp, Homo sapiens
  misc_feature: HIJSMM301C3NQ1.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgacccgtctaagtcagcccaaggctgccccctc

SEQ ID NO: 576166 - DNA, 500 bp, Homo sapiens
  misc_feature: HIJSMM301ALCT5.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaacgcccccaaactcatgatttatgaggtcacaaagccggccctcaggggtccctgatcgcttctctgcctccaagtctggcaacacggcctccctgaccgtctctgggctccagcctgaggatgaggctgattattactgcagctcatatgcaggcatcaacacttgttttcggcggagggaccaagctgaccgtcctaggtcagcccaaggctgccccctcggtcactctcgttcccaccctcctcgagtgcgtct

SEQ ID NO: 576167 - DNA, 492 bp, Homo sapiens; identical to SEQ ID NO: 535126
  misc_feature: HIJSMM301D7ISY.18.11.A11.1.454.light.4.raw

SEQ ID NO: 576168 - DNA, 505 bp, Homo sapiens
  misc_feature: HIJSMM301AIWGC.15.66.F11.1.454.light.4.raw
tctacgtagccacgaccggtgctcgatttagtcacgcgagaagggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagcttttgtcttcggaagtgggaccaaggtcaccgtctaagtcagcccaaggccaaccccactgtcactctgttcccgccct

SEQ ID NO: 576169 - DNA, 487 bp, Homo sapiens; identical to SEQ ID NO: 537208
  misc_feature: HIJSMM301AKT9N.3.55.E11.1.454.light.4.raw

SEQ ID NO: 576170 - DNA, 448 bp, Homo sapiens
  misc_feature: HIJSMM301B6KW0.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaaggccaacccctctgtcactctgttcccgccctcctccatactcgta

SEQ ID NO: 576171 - DNA, 478 bp, Homo sapiens
  misc_feature: HIJSMM301C62S0.19.77.G11.1.454.light.4.raw
tactctcgtgcacgaccggtgctcgatttagctagtcactcaagggaaagggtgacatccctcactgtggctcacgttcggcggagggaccgaggtggagatcaaacgtaagtgcactatccgaatgctttttgttataaggttttgatttggaggggttttgtgtttgagatatgaggtcaggtcaattccaaagagtaccagattctttcagaaagtcagatgagtaagggacagaaacttagttcatcttaaggaacagccaagcgctagccagttaagtgaggcatctcaattgcaagattttctctgcatcggtcaggttagtgatattaacagagaaaagagtatttttgttaaggggaaagtaattaagctaacactgtggatcaccttcggccaagggacacgactggagattaaacgaactgtggctgcaccatctgtcttcatcttcccgccatctgacacgagagta

SEQ ID NO: 576172 - DNA, 501 bp, Homo sapiens
  misc_feature: HIJSMM301DRUCO.41.45.E01.1.454.light.4.raw
tctatactatcacgaccggtgctcgatttagtgagtcagtaagggaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactc

SEQ ID NO: 576173 - DNA, 501 bp, Homo sapiens
  misc_feature: HIJSMM301C5QQ2.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctctttccaccctggctgcatctgtaggagacagagtcaccatcacttgtcgggccagtcagaatattaatagttggttggcctggtatcaacagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatcttccccg

SEQ ID NO: 576174 - DNA, 483 bp, Homo sapiens; identical to SEQ ID NO: 540738
  misc_feature: HIJSMM301CAHQ7.48.85.H08.1.454.light.4.raw

SEQ ID NO: 576175 - DNA, 486 bp, Homo sapiens; identical to SEQ ID NO: 540808
  misc_feature: HIJSMM301C3NPL.26.70.G04.1.454.light.4.raw

SEQ ID NO: 576176 - DNA, 494 bp, Homo sapiens; identical to SEQ ID NO: 534994
  misc_feature: HIJSMM301EURJW.27.78.H01.1.454.light.4.raw

SEQ ID NO: 576177 - DNA, 447 bp, Homo sapiens; identical to SEQ ID NO: 535020
  misc_feature: HIJSMM301CV0AP.18.9.A09.1.454.light.4.raw

SEQ ID NO: 576178 - DNA, 494 bp, Homo sapiens; identical to SEQ ID NO: 535629
  misc_feature: HIJSMM301AXIFE.4.27.C05.1.454.light.4.raw

SEQ ID NO: 576179 - DNA, 502 bp, Homo sapiens
  misc_feature: HIJSMM301EZW17.40.33.C11.1.454.light.4.raw
tctagcgactcacgaccggtgctcgattagagtgagctcgttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctc

SEQ ID NO: 576180 - DNA, 486 bp, Homo sapiens; identical to SEQ ID NO: 535385
  misc_feature: HIJSMM301C1NBS.19.71.G05.1.454.light.4.raw

SEQ ID NO: 576181 - DNA, 498 bp, Homo sapiens
  misc_feature: HIJSMM301C4R24.12.37.D04.1.454.light.4.raw
  modified_base (366)..(366): a, c, t, g, unknown or other
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttacccncaccatcagcagcctgcagcctgaagatcttgcaacatattactgtcaacagtaataataatctcccgtacacttttggccaggggaccaagctggagatcaaacgaactgtggctgcaccatctgtcttca

SEQ ID NO: 576182 - DNA, 486 bp, Homo sapiens; identical to SEQ ID NO: 537144
  misc_feature: HIJSMM301DZLYZ.46.35.D02.1.454.light.4.raw

SEQ ID NO: 576183 - DNA, 528 bp, Homo sapiens
  misc_feature: HIJSMM301C81X6.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaagggaccgaacggtaggaaggtacgaaacgaactacgtggcgtggcaccatctgttcttcctattcttcccgtcccactactcgat

SEQ ID NO: 576184 - DNA, 516 bp, Homo sapiens
  misc_feature: HIJSMM301AWC1A.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagccaaggctcgccccctcggtcactctcgttcccccg

SEQ ID NO: 576185 - DNA, 493 bp, Homo sapiens
  misc_feature: HIJSMM301CQLT0.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcgagtctggaccgaggtcgaccgtcctagtcgagcccaacggcaaccccaacctcg

SEQ ID NO: 576186 - DNA, 506 bp, Homo sapiens; identical to SEQ ID NO: 535191
  misc_feature: HIJSMM301CR4QF.14.7.A07.1.454.light.4.raw

SEQ ID NO: 576187 - DNA, 488 bp, Homo sapiens; identical to SEQ ID NO: 535568
  misc_feature: HIJSMM301BMK6H.21.4.A04.1.454.light.4.raw

SEQ ID NO: 576188 - DNA, 486 bp, Homo sapiens; identical to SEQ ID NO: 535043
  misc_feature: HIJSMM301B5TXQ.46.35.D02.1.454.light.4.raw

SEQ ID NO: 576189 - DNA, 402 bp, Homo sapiens
  misc_feature: HIJSMM301A2QLZ.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaacccactgtcactctgttcccacctcctcctacagtgct

SEQ ID NO: 576190 - DNA, 495 bp, Homo sapiens
  misc_feature: HIJSMM301B9R91.4.38.D05.1.454.light.4.raw
agcactgtagcacgaccggtgctcgatttagtatctgatagttgggtttgggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtgtggtagctcaccgacgttcggccaagggaccgaaggtaggaaatcaaacgaactagtggctgcaccactctgtt

SEQ ID NO: 576191 - DNA, 484 bp, Homo sapiens
  misc_feature: HIJSMM301DBCCJ.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 576192 - DNA, 491 bp, Homo sapiens; identical to SEQ ID NO: 535176
  misc_feature: HIJSMM301BW8BN.13.39.D06.1.454.light.4.raw

SEQ ID NO: 576193 - DNA, 501 bp, Homo sapiens
  misc_feature: HIJSMM301BVJZW.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccagggtccaagctggagatggaaacgaactgtggctgcaccatctgtcttcatcttccccg

SEQ ID NO: 576194 - DNA, 498 bp, Homo sapiens
  misc_feature: HIJSMM301B5ZLT.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccaaactgaccgtcccaggtcagcccaaggctgccccctcggtcactctgttcccccg

SEQ ID NO: 576195 - DNA, 479 bp, Homo sapiens
  misc_feature: HIJSMM301A6U10.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccacctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgctagtttattactgtcagcagtatgttgactggcctcgctcactttcggcggagggaccaaggtggagatcagacgaactgtggctgcacc

SEQ ID NO: 576196 - DNA, 514 bp, Homo sapiens
  misc_feature: HIJSMM301EEXFG.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgtcccaccct

SEQ ID NO: 576197 - DNA, 517 bp, Homo sapiens
  misc_feature: HIJSMM301EYUQ7.41.33.C11.1.454.light.4.raw
tctatactatcacgaccggtgctcgatttagagtgagctcgttgggtttggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccgccct

SEQ ID NO: 576198 - DNA, 490 bp, Homo sapiens
  misc_feature: HIJSMM301A68NZ.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcaggcgggtcagggacagattttacactgaaaatcaggccgggtggaggctgaggacgttggaatttattactgtatgcaaggtatagagcttcctccgacgttcgaccgaaggaccaaggtggaactacaaacgaa

SEQ ID NO: 576199 - DNA, 518 bp, Homo sapiens
  misc_feature: HIJSMM301CH2L3.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccgccctcctcta

SEQ ID NO: 576200 - DNA, 488 bp, Homo sapiens; identical to SEQ ID NO: 537124
  misc_feature: HIJSMM301B8IK5.11.25.C03.1.454.light.4.raw

SEQ ID NO: 576201 - DNA, 495 bp, Homo sapiens; identical to SEQ ID NO: 543094
  misc_feature: HIJSMM301B0HME.22.57.F02.1.454.light.4.raw

SEQ ID NO: 576202 - DNA, 496 bp, Homo sapiens; identical to SEQ ID NO: 535660
  misc_feature: HIJSMM301DL016.43.25.C03.1.454.light.4.raw

SEQ ID NO: 576203 - DNA, 447 bp, Homo sapiens; identical to SEQ ID NO: 535201
  misc_feature: HIJSMM301ASVER.18.9.A09.1.454.light.4.raw

SEQ ID NO: 576204 - DNA, 447 bp, Homo sapiens
  misc_feature: HIJSMM301DRTM4.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttctcgccctcctccatactcgta

SEQ ID NO: 576205 - DNA, 496 bp, Homo sapiens
  misc_feature: HIJSMM301CRJ8Z.43.83.H06.1.454.light.4.raw
tgtgagtagtcacgaccggtgctcgatttagatcacgtgcgtcgcgggggctgctcagttaggacccagagggaaccatggaaaccccagcgcagcttctcttcctcctgctactctggctcccagataccaccggagaaactgtgttgacgcagtctccaggcacgctgtctttgtctccaggggaaagagccaccctctcgtgtagggccagtcagagtgttatcaccgactccttagcctggtaccagcagaaacctggccaggctcccaggctcctcatatatggtgcatccagcaggatcactggcatcccagcgaggttcagtggccatgggtctgggacggagttcactctcaccatcagccgactggagcctgaagattttgcagtatattactgtcaacaatatggtagttctcctctcactttcggcggagggaccaaggtggaagtcaaacgaactgtggctgcaccatctgtcttcatcttccg

SEQ ID NO: 576206 - DNA, 494 bp, Homo sapiens; identical to SEQ ID NO: 537418
  misc_feature: HIJSMM301DKOWD.9.1.A01.1.454.light.4.raw

SEQ ID NO: 576207 - DNA, 486 bp, Homo sapiens; identical to SEQ ID NO: 554930
  misc_feature: HIJSMM301A1CC4.47.78.H01.1.454.light.4.raw

SEQ ID NO: 576208 - DNA, 486 bp, Homo sapiens; identical to SEQ ID NO: 535385
  misc_feature: HIJSMM301BKBTH.19.71.G05.1.454.light.4.raw

SEQ ID NO: 576209 - DNA, 445 bp, Homo sapiens; identical to SEQ ID NO: 551271
  misc_feature: HIJSMM301DJWFX.5.9.A09.1.454.light.4.raw

SEQ ID NO: 576210 - DNA, 511 bp, Homo sapiens; identical to SEQ ID NO: 557789
  misc_feature: HIJSMM301CJK55.53.71.G05.1.454.light.4.raw

SEQ ID NO: 576211 - DNA, 494 bp, Homo sapiens; identical to SEQ ID NO: 534992
  misc_feature: HIJSMM301AEWI1.9.1.A01.1.454.light.4.raw

SEQ ID NO: 576212 - DNA, 496 bp, Homo sapiens; identical to SEQ ID NO: 537925
  misc_feature: HIJSMM301EUUMQ.22.14.B03.1.454.light.4.raw

SEQ ID NO: 576213 - DNA, 491 bp, Homo sapiens
  misc_feature: HIJSMM301BJM12.49.27.C05.1.454.light.4.raw
agtcgagagacacgaccggtgctcgatttagacgcgatcgaagggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccatctgt

SEQ ID NO: 576214 - DNA, 494 bp, Homo sapiens
  misc_feature: HIJSMM301AW6GG.48.71.G05.1.454.light.4.raw
agtatacatacacgaccggtgctcgatttagtgtcgtcgcaagagagaggggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccgccatctgatatgtatact

SEQ ID NO: 576215 - DNA, 498 bp, Homo sapiens
  misc_feature: HIJSMM301B9RG4.40.4.A04.1.454.light.4.raw
  modified_base (370)..(370): a, c, t, g, unknown or other
tctagcgactcacgaccggtgctcgatttagagtagtgatcagggggagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttacnctcaccatcaccagccttcaggctgaagatgtggcagtttattactgtcaccaatatttagacattcctccgacgttcggccaagggaccaaggtggagatcaaacgaactgtggctgcaccatctgt

SEQ ID NO: 576216 - DNA, 513 bp, Homo sapiens
  misc_feature: HIJSMM301BOIMA.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactcttccg

SEQ ID NO: 576217 - DNA, 490 bp, Homo sapiens
  misc_feature: HIJSMM301EQC80.22.65.F10.1.454.light.4.raw
acatacgcgtcacgaccggtgctcgatttagctacgctctaagggggagtcagtctcagtcaggacacagcatggacatgagggtccccgctcacctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccctcgatcaccttcggccaagggacacgactggagattaaacgaactgtggctgcaccatctgtcttcat

SEQ ID NO: 576218 - DNA, 496 bp, Homo sapiens; identical to SEQ ID NO: 540132
  misc_feature: HIJSMM301EB0GI.3.71.G05.1.454.light.4.raw

SEQ ID NO: 576219 - DNA, 497 bp, Homo sapiens; identical to SEQ ID NO: 536371
  misc_feature: HIJSMM301EC8IL.16.78.H01.1.454.light.4.raw

SEQ ID NO: 576220 - DNA, 493 bp, Homo sapiens
  misc_feature: HIJSMM301C7RV4.27.78.H01.1.454.light.4.raw
  modified_base (461)..(461): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactgganattaaacgaactgtggctgcaccatctgtctt

SEQ ID NO: 576221 - DNA, 485 bp, Homo sapiens; identical to SEQ ID NO: 536576
  misc_feature: HIJSMM301EAASR.46.35.D02.1.454.light.4.raw

SEQ ID NO: 576222 - DNA, 495 bp, Homo sapiens
  misc_feature: HIJSMM301DKGV8.5.48.E04.1.454.light.4.raw
atcagacacgcacgaccggtgctcgatttagagagcgtcacagagagaaggggctggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcacttttcggcggagggaccaaggtggagagcagacgaactgtggctgcaccta

SEQ ID NO: 576223 - DNA, 506 bp, Homo sapiens
  misc_feature: HIJSMM301BAN8F.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactgacatcccagccaggttcagtggcagtgggtatgggacagacttcactctcaccatcatcagcctggagcctgaggatgttgcagtttattactgtcaacatcgtaccgagtggcctccggggccactttcggccctgggaccaagtggatatcaaacgaactgtggctgcaccatctgtcttcta

SEQ ID NO: 576224 - DNA, 486 bp, Homo sapiens; identical to SEQ ID NO: 535043
  misc_feature: HIJSMM301EF23W.46.35.D02.1.454.light.4.raw

SEQ ID NO: 576225 - DNA, 502 bp, Homo sapiens; identical to SEQ ID NO: 562863
  misc_feature: HIJSMM301CTN2B.40.42.D09.1.454.light.4.raw

SEQ ID NO: 576226 - DNA, 497 bp, Homo sapiens; identical to SEQ ID NO: 535829
  misc_feature: HIJSMM301AFCQD.5.24.C02.1.454.light.4.raw

SEQ ID NO: 576227 - DNA, 493 bp, Homo sapiens; identical to SEQ ID NO: 537239
  misc_feature: HIJSMM301AXPHF.49.66.F11.1.454.light.4.raw

SEQ ID NO: 576228 - DNA, 447 bp, Homo sapiens; identical to SEQ ID NO: 535020
  misc_feature: HIJSMM301A4TIZ.18.9.A09.1.454.light.4.raw

SEQ ID NO: 576229 - DNA, 505 bp, Homo sapiens
  misc_feature: HIJSMM301CX5D8.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgagggcgaggctgattattactgcagctcatatactattagcagaactgtggttttcggcggagggaccaaggtgaccgtcctaggtcagcccaaggctgccccctcggtcactctcg

SEQ ID NO: 576230 - DNA, 494 bp, Homo sapiens; identical to SEQ ID NO: 534994
  misc_feature: HIJSMM301APYV6.27.78.H01.1.454.light.4.raw

SEQ ID NO: 576231 - DNA, 521 bp, Homo sapiens
  misc_feature: HIJSMM301D5KK4.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgagacgaggctgattattattgtagtttcatatacaaccagtgacacttgggtgttcggcggagggaccaggctgaccgtcctaggtcagcccaaggctgccccctcggtcactctgttcccacct

SEQ ID NO: 576232 - DNA, 494 bp, Homo sapiens; identical to SEQ ID NO: 535478
  misc_feature: HIJSMM301CO1UW.10.79.H02.1.454.light.4.raw

SEQ ID NO: 576233 - DNA, 505 bp, Homo sapiens; identical to SEQ ID NO: 535503
  misc_feature: HIJSMM301CTIJP.8.28.C06.1.454.light.4.raw

SEQ ID NO: 576234 - DNA, 490 bp, Homo sapiens; identical to SEQ ID NO: 556698
  misc_feature: HIJSMM301BRXTT.15.3.A03.1.454.light.4.raw
  modified_base (431)..(431): a, c, t, g, unknown or other

SEQ ID NO: 576235 - DNA, 522 bp, Homo sapiens
  misc_feature: HIJSMM301D5E4Y.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcataatacaaccagtgacacgttgggtgttcgggcggagggaccaggctgaccgtcctaggtcagcccaaggctgccccctcggtcactctgttcctcgt

SEQ ID NO: 576236 - DNA, 487 bp, Homo sapiens; identical to SEQ ID NO: 543137
  misc_feature: HIJSMM301BM00Y.40.83.H06.1.454.light.4.raw

SEQ ID NO: 576237 - DNA, 488 bp, Homo sapiens
  misc_feature: HIJSMM301DGA1Z.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaaggaccgaacggtggaaagtcaaacgaactagtggctgcaccta

SEQ ID NO: 576238 - DNA, 503 bp, Homo sapiens; identical to SEQ ID NO: 547049
  misc_feature: HIJSMM301A8OUJ.18.59.F04.1.454.light.4.raw

SEQ ID NO: 576239 - DNA, 506 bp, Homo sapiens
  misc_feature: HIJSMM301DU1XK.16.46.E02.1.454.light.4.raw
tgtactactccacgaccggtgctcgatttagactcatctacagggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgcttcggaactgggaccaaggtcaccgtcctaggtcagcccaaggccaaccccactgtcact

SEQ ID NO: 576240 - DNA, 485 bp, Homo sapiens; identical to SEQ ID NO: 535985
  misc_feature: HIJSMM301BZ6OH.15.1.A01.1.454.light.4.raw

SEQ ID NO: 576241 - DNA, 494 bp, Homo sapiens; identical to SEQ ID NO: 539922
  misc_feature: HIJSMM301CBLX7.27.78.H01.1.454.light.4.raw

SEQ ID NO: 576242 - DNA, 496 bp, Homo sapiens
  misc_feature: HIJSMM301D2AZ2.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccccg

SEQ ID NO: 576243 - DNA, 495 bp, Homo sapiens; identical to SEQ ID NO: 535007
  misc_feature: HIJSMM301B5KCZ.22.5.A05.1.454.light.4.raw

SEQ ID NO: 576244 - DNA, 494 bp, Homo sapiens; identical to SEQ ID NO: 562043
  misc_feature: HIJSMM301DD89I.52.38.D05.1.454.light.4.raw

SEQ ID NO: 576245 - DNA, 496 bp, Homo sapiens; identical to SEQ ID NO: 536802
  misc_feature: HIJSMM301EAQNK.5.24.C02.1.454.light.4.raw

SEQ ID NO: 576246 - DNA, 384 bp, Homo sapiens; identical to SEQ ID NO: 540224
  misc_feature: HIJSMM301DV9M7.48.53.E09.1.454.light.4.raw

SEQ ID NO: 576247 - DNA, 496 bp, Homo sapiens; identical to SEQ ID NO: 553382
  misc_feature: HIJSMM301DSCSK.51.59.F04.1.454.light.4.raw

SEQ ID NO: 576248 - DNA, 482 bp, Homo sapiens; identical to SEQ ID NO: 535216
  misc_feature: HIJSMM301BHIHP.17.26.C04.1.454.light.4.raw

SEQ ID NO: 576249 - DNA, 492 bp, Homo sapiens; identical to SEQ ID NO: 536175
  misc_feature: HIJSMM301BEMZ9.19.83.H06.1.454.light.4.raw

SEQ ID NO: 576250 - DNA, 496 bp, Homo sapiens; identical to SEQ ID NO: 537925
  misc_feature: HIJSMM301A2OGG.22.14.B03.1.454.light.4.raw

SEQ ID NO: 576251 - DNA, 514 bp, Homo sapiens
  misc_feature: HIJSMM301A1ABG.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctcgttcccc

SEQ ID NO: 576252 - DNA, 513 bp, Homo sapiens
  misc_feature: HIJSMM301DLBC0.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcacgtcctaggtcagcccaaggccaaccccactgtcactctgttcccgccctcctcga

SEQ ID NO: 576253 - DNA, 490 bp, Homo sapiens
  misc_feature: HIJSMM301CMDIC.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatacaaacgaact

SEQ ID NO: 576254 - DNA, 496 bp, Homo sapiens; identical to SEQ ID NO: 535541
  misc_feature: HIJSMM301CUOGP.3.33.C11.1.454.light.4.raw

SEQ ID NO: 576255 - DNA, 513 bp, Homo sapiens
  misc_feature: HIJSMM301CSOX8.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaggaccaggtgcaatcaacgaactgtggctgcaccatctgtcttcatcttccccg

SEQ ID NO: 576256 - DNA, 489 bp, Homo sapiens; identical to SEQ ID NO: 535139
  misc_feature: HIJSMM301EQ7I0.14.55.E11.1.454.light.4.raw

SEQ ID NO: 576257 - DNA, 505 bp, Homo sapiens; identical to SEQ ID NO: 555744
  misc_feature: HIJSMM301BJBWI.7.71.G05.1.454.light.4.raw

SEQ ID NO: 576258 - DNA, 483 bp, Homo sapiens; identical to SEQ ID NO: 535777
  misc_feature: HIJSMM301CG80L.10.1.A01.1.454.light.4.raw

SEQ ID NO: 576259 - DNA, 490 bp, Homo sapiens; identical to SEQ ID NO: 541567
  misc_feature: HIJSMM301DSNQU.22.65.F10.1.454.light.4.raw

SEQ ID NO: 576260 - DNA, 494 bp, Homo sapiens; identical to SEQ ID NO: 550130
  misc_feature: HIJSMM301A6FHM.12.38.D05.1.454.light.4.raw

SEQ ID NO: 576261 - DNA, 482 bp, Homo sapiens
  misc_feature: HIJSMM301BSR9R.49.57.F02.1.454.light.4.raw
agtcgagagacacgaccggtgctcgatttagctcgatatagttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgttttggccaggggaccaagctggagatcaagcgaactgtggctgcaccat

SEQ ID NO: 576262 - DNA, 465 bp, Homo sapiens
  misc_feature: HIJSMM301COCKY.51.67.G01.1.454.light.4.raw
  modified_base (409)..(409): a, c, t, g, unknown or other
cgatcgtatacacgaccggtgctcgatttagagtatacatattgggtttggggcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacngtaatgatagtctccgctcactttcggcggggggaccaaggtggagatcaagcgaa

SEQ ID NO: 576263 - DNA, 377 bp, Homo sapiens; identical to SEQ ID NO: 536071
  misc_feature: HIJSMM301DP4WW.40.9.A09.1.454.light.4.raw

SEQ ID NO: 576264 - DNA, 486 bp, Homo sapiens; identical to SEQ ID NO: 535043
  misc_feature: HIJSMM301APQNR.46.35.D02.1.454.light.4.raw

SEQ ID NO: 576265 - DNA, 444 bp, Homo sapiens; identical to SEQ ID NO: 537971
  misc_feature: HIJSMM301BNO4N.2.76.G10.1.454.light.4.raw

SEQ ID NO: 576266 - DNA, 492 bp, Homo sapiens; identical to SEQ ID NO: 535126
  misc_feature: HIJSMM301CEU69.18.11.A11.1.454.light.4.raw

SEQ ID NO: 576267 - DNA, 499 bp, Homo sapiens
  misc_feature: HIJSMM301CYDX7.40.37.D04.1.454.light.4.raw
tctagcgactcacgaccggtgctcgatttagtagcatactgttgggtttggggaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtccctcgggtaccgacgagtggagtgtcgaaacgaacctagtggcgtcg

SEQ ID NO: 576268 - DNA, 500 bp, Homo sapiens
  misc_feature: HIJSMM301AGYPI.12.86.H09.1.454.light.4.raw
  modified_base (436)..(436): a, c, t, g, unknown or other
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagcttcactctcaccatcagcagcctagagcctgaagattttgcagtttatactgtcagcagcgtagcaactggcctcggttcncttttggccaggggaccaagctggagatcaaacgaactgtggctggcaccatctgcttcattcc

SEQ ID NO: 576269 - DNA, 498 bp, Homo sapiens
  misc_feature: HIJSMM301DKV47.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcta

SEQ ID NO: 576270 - DNA, 505 bp, Homo sapiens
  misc_feature: HIJSMM301CLSET.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctctggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgcttgttttttcggtcggtcgggaccaagctgaccgtcctaggtcagcccaaggctgccccctcggt

SEQ ID NO: 576271 - DNA, 503 bp, Homo sapiens
  misc_feature: HIJSMM301BIWRM.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggactaaactgaccgtcttaggtcagcccaaggctcgtcccccg

SEQ ID NO: 576272 - DNA, 505 bp, Homo sapiens; identical to SEQ ID NO: 535503
  misc_feature: HIJSMM301DB9B3.8.28.C06.1.454.light.4.raw

SEQ ID NO: 576273 - DNA, 498 bp, Homo sapiens
  misc_feature: HIJSMM301BBBLY.41.18.B07.1.454.light.4.raw
tctatactatcacgaccggtgctcgatttagtcgctgcgtaagggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactatattgtcaagcagtagacagcagtggtccttatcgggtgttcggcggggggaccgaagctgaccgtcctaggtcagcccaacggctccg

SEQ ID NO: 576274 - DNA, 505 bp, Homo sapiens
  misc_feature: HIJSMM301DKDJN.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtctttatcttcccgccat

SEQ ID NO: 576275 - DNA, 490 bp, Homo sapiens
  misc_feature: HIJSMM301DA700.18.22.B11.1.454.light.4.raw
tacgagtatgcacgaccggtgctcgatttagacgacagctcaggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtattttaaagaactccaacaatcagaattacttaacttggtatcagcagaaagcaggccagcctcccaagttgctcatttactgggcatcaacccgggaatccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatctcccgcat

SEQ ID NO: 576276 - DNA, 507 bp, Homo sapiens
  misc_feature: HIJSMM301AKCFZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaacggtaggaaagtacaaacgaactagtggctgcaccatctgtcttcatcttccccg

SEQ ID NO: 576277 - DNA, 444 bp, Homo sapiens; identical to SEQ ID NO: 537971
  misc_feature: HIJSMM301CTPIL.2.76.G10.1.454.light.4.raw

SEQ ID NO: 576278 - DNA, 517 bp, Homo sapiens
  misc_feature: HIJSMM301D3YQG.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctgtggggaaacaacattggaagtaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctcgccccctcggtcactctcgttcccccg

SEQ ID NO: 576279 - DNA, 493 bp, Homo sapiens
  misc_feature: HIJSMM301EY83X.10.37.D04.1.454.light.4.raw
catagtagtgcacgaccggtgctcgatttagtagcatactgttgggtttggggcagagctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggcgttcgccaggaccgaaggtaggaccgtacaaacgaactagtgg

SEQ ID NO: 576280 - DNA, 506 bp, Homo sapiens
  misc_feature: HIJSMM301A62T9.10.29.C07.1.454.light.4.raw
catagtagtgcacgaccggtgctcgatttagagtgctacgaagggaaaggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctgccccctcggtca

SEQ ID NO: 576281 - DNA, 505 bp, Homo sapiens
  misc_feature: HIJSMM301A251N.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactaggcctccgtactagtttaggtccgacggggaccgaacgactggtagagtacaaacgaaactacgtggcgtcg

SEQ ID NO: 576282 - DNA, 495 bp, Homo sapiens
  misc_feature: HIJSMM301AC72A.51.12.B01.1.454.light.4.raw
cgatcgtatacacgaccggtgctcgatttagtagtgtagattccgcgggggtgggtccaggaggcagaactctgggtgtctcaccatggcctggatccctctacttctccccctcctcactctctgcacaggctctgagggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccagggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccacctgtcact

SEQ ID NO: 576283 - DNA, 490 bp, Homo sapiens
  misc_feature: HIJSMM301C0QBH.14.36.D03.1.454.light.4.raw
cgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaacgcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcgggggaccgaggtgaccgtcctaggtcagccc

SEQ ID NO: 576284 - DNA, 488 bp, Homo sapiens; identical to SEQ ID NO: 537329
  misc_feature: HIJSMM301CVQKD.26.23.C01.1.454.light.4.raw

SEQ ID NO: 576285 - DNA, 473 bp, Homo sapiens; identical to SEQ ID NO: 557480
  misc_feature: HIJSMM301BTRWH.18.76.G10.1.454.light.4.raw

SEQ ID NO: 576286 - DNA, 516 bp, Homo sapiens; identical to SEQ ID NO: 538293
  misc_feature: HIJSMM301BALS5.14.19.B08.1.454.light.4.raw

SEQ ID NO: 576287 - DNA, 504 bp, Homo sapiens; identical to SEQ ID NO: 545347
  misc_feature: HIJSMM301EOQC1.27.78.H01.1.454.light.4.raw

SEQ ID NO: 576288 - DNA, 484 bp, Homo sapiens
  misc_feature: HIJSMM301EQ13U.3.10.A10.1.454.light.4.raw
  modified_base (435)..(435): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtnttcggatctggaaccagggtcacgtcctaggtcagccaaggccaaccca

SEQ ID NO: 576289 - DNA, 513 bp, Homo sapiens; identical to SEQ ID NO: 535719
  misc_feature: HIJSMM301EEO2P.17.33.C11.1.454.light.4.raw

SEQ ID NO: 576290 - DNA, 469 bp, Homo sapiens
  misc_feature: HIJSMM301DPT8U.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggccctggactgaagtgcatatgaagagaactgtgg

SEQ ID NO: 576291 - DNA, 514 bp, Homo sapiens; identical to SEQ ID NO: 559713
  misc_feature: HIJSMM301ANCDJ.8.23.C01.1.454.light.4.raw

SEQ ID NO: 576292 - DNA, 499 bp, Homo sapiens
  misc_feature: HIJSMM301EOWET.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcgggtcagagttcactctcaccatcagcagcctgcagtctgaagattttgctagtttattactgtcagcagtatgatacctggccttccgtactacgttttgggccggggaccaagctaggaaatcaagcgaactgtggctgcacatctgtcttcattccc

SEQ ID NO: 576293 - DNA, 506 bp, Homo sapiens
  misc_feature: HIJSMM301EAWYA.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactagtggctgcaccatctgt

SEQ ID NO: 576294 - DNA, 495 bp, Homo sapiens
  misc_feature: HIJSMM301EERS9.3.35.D02.1.454.light.4.raw
agacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccaggggccaagctggagatcaaacgaactgtggctgcacc

SEQ ID NO: 576295 - DNA, 467 bp, Homo sapiens; identical to SEQ ID NO: 538403
  misc_feature: HIJSMM301EJNG7.41.48.E04.1.454.light.4.raw

SEQ ID NO: 576296 - DNA, 506 bp, Homo sapiens; identical to SEQ ID NO: 551500
  misc_feature: HIJSMM301CAAZX.8.33.C11.1.454.light.4.raw

SEQ ID NO: 576297 - DNA, 495 bp, Homo sapiens
  misc_feature: HIJSMM301CSMZ9.49.6.A06.1.454.light.4.raw
agtcgagagacacgaccggtgctcgatttagatctactgacaggggggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcagggtccctgatcgcttctctggctccaagtctggcaacacggcctcctgaccgtctctgggctccgggctgaagatgaggctgattattcttgcagctcatatgcaggcagcaacaatttgtgatattcggcggagggaccaagctgaccgtctaggtcagcccaaggctcgccccctcc

SEQ ID NO: 576298 - DNA, 505 bp, Homo sapiens
  misc_feature: HIJSMM301CXLD8.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgacttttgcagtttatttctgtcagcagtctgaagactggccgttcactttcggcggagggaccaaggtggacctcaaacgaactgtggctgcaccatctgtcttcatcttcccgcc

SEQ ID NO: 576299 - DNA, 486 bp, Homo sapiens; identical to SEQ ID NO: 535043
  misc_feature: HIJSMM301C24N3.46.35.D02.1.454.light.4.raw

SEQ ID NO: 576300 - DNA, 491 bp, Homo sapiens; identical to SEQ ID NO: 538021
  misc_feature: HIJSMM301ASYX5.3.72.G06.1.454.light.4.raw

SEQ ID NO: 576301 - DNA, 519 bp, Homo sapiens
  misc_feature: HIJSMM301DNS9Y.9.86.H09.1.454.light.4.raw
tgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccgccctcctc

SEQ ID NO: 576302 - DNA, 486 bp, Homo sapiens; identical to SEQ ID NO: 535043
  misc_feature: HIJSMM301CLJLL.46.35.D02.1.454.light.4.raw

SEQ ID NO: 576303 - DNA, 502 bp, Homo sapiens; identical to SEQ ID NO: 544940
  misc_feature: HIJSMM301BAA0Z.9.53.E09.1.454.light.4.raw

SEQ ID NO: 576304 - DNA, 486 bp, Homo sapiens; identical to SEQ ID NO: 535043
  misc_feature: HIJSMM301EGVIW.46.35.D02.1.454.light.4.raw

SEQ ID NO: 576305 - DNA, 478 bp, Homo sapiens; identical to SEQ ID NO: 535129
  misc_feature: HIJSMM301DMGGD.11.11.A11.1.454.light.4.raw

SEQ ID NO: 576306 - DNA, 447 bp, Homo sapiens
  misc_feature: HIJSMM301AIT3A.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggtcaacccctctgtcactctgttcccaccctcctccatactcgta

SEQ ID NO: 576307 - DNA, 513 bp, Homo sapiens
  misc_feature: HIJSMM301AZV7H.40.46.E02.1.454.light.4.raw
tctagcgactcacgaccggtgctcgatttagactcatctacagggaaaggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcg

SEQ ID NO: 576308 - DNA, 489 bp, Homo sapiens
  misc_feature: HIJSMM301CY83D.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaatcagcagggtggaggctgaggatgttattgggctctattattgcatgcaagcaacacactggccgtacacttttggccaggggaccaagctggagatcaatcgaactgt

SEQ ID NO: 576309 - DNA, 484 bp, Homo sapiens; identical to SEQ ID NO: 535240
  misc_feature: HIJSMM301ARMVU.47.60.F05.1.454.light.4.raw

SEQ ID NO: 576310 - DNA, 484 bp, Homo sapiens
  misc_feature: HIJSMM301BTQYP.51.34.D01.1.454.light.4.raw
cgatcgtatacacgaccggtgctcgatttagatcgtctgtgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctcgatgcatccactttggaaacaggggtcccatcaaggttcagtggaagtggctctgggacagtatttttactttcaccatcagcaggctgcagcctgaagacattgcaacatattactgtcaacagtatgatagtcctcccgctctactttcggcggagggaccaaggtggggatacaacgaactgtggctgcaccta

SEQ ID NO: 576311 - DNA, 503 bp, Homo sapiens; identical to SEQ ID NO: 538884
  misc_feature: HIJSMM301BYDJY.27.78.H01.1.454.light.4.raw

SEQ ID NO: 576312 - DNA, 501 bp, Homo sapiens; identical to SEQ ID NO: 555551
  misc_feature: HIJSMM301EDOXH.21.81.H04.1.454.light.4.raw

SEQ ID NO: 576313 - DNA, 485 bp, Homo sapiens
  misc_feature: HIJSMM301CIO8R.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttctcgccatctgactagtcttacg

SEQ ID NO: 576314 - DNA, 487 bp, Homo sapiens
  misc_feature: HIJSMM301ATTK9.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctggggaccaaagtggagatcaaacgaa

SEQ ID NO: 576315 - DNA, 494 bp, Homo sapiens; identical to SEQ ID NO: 536444
  misc_feature: HIJSMM301CIV5B.26.72.G06.1.454.light.4.raw

SEQ ID NO: 576316 - DNA, 516 bp, Homo sapiens
  misc_feature: HIJSMM301CGVSY.49.57.F02.1.454.light.4.raw
agtcgagagacacgaccggtgctcgatttagctcgatatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctgttcccg

SEQ ID NO: 576317 - DNA, 503 bp, Homo sapiens
  misc_feature: HIJSMM301EECTV.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgtgtcagcccaaggctgcccctcggtcactctgttcccgcctcctctacgtcgtat

SEQ ID NO: 576318 - DNA, 504 bp, Homo sapiens; identical to SEQ ID NO: 564613
  misc_feature: HIJSMM301CS6O4.15.86.H09.1.454.light.4.raw

SEQ ID NO: 576319 - DNA, 490 bp, Homo sapiens
  misc_feature: HIJSMM301AMQSN.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccgaagtggaaatacaaacgaactagtggctgcaccat

SEQ ID NO: 576320 - DNA, 487 bp, Homo sapiens; identical to SEQ ID NO: 537220
  misc_feature: HIJSMM301CU0UD.16.53.E09.1.454.light.4.raw

SEQ ID NO: 576321 - DNA, 503 bp, Homo sapiens
  misc_feature: HIJSMM301C21PA.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctg

SEQ ID NO: 576322 - DNA, 508 bp, Homo sapiens
  misc_feature: HIJSMM301CO8NK.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactgtggctgcaccatctgtcttcatcttcccg

SEQ ID NO: 576323 - DNA, 513 bp, Homo sapiens
  misc_feature: HIJSMM301DIHV1.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactcctcc

SEQ ID NO: 576324 - DNA, 459 bp, Homo sapiens
  misc_feature: HIJSMM301AGRZL.14.57.F02.1.454.light.4.raw
  modified_base (457)..(457): a, c, t, g, unknown or other
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctatctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggcggaacgtggngt

SEQ ID NO: 576325 - DNA, 486 bp, Homo sapiens; identical to SEQ ID NO: 563598
  misc_feature: HIJSMM301B844U.14.53.E09.1.454.light.4.raw

SEQ ID NO: 576326 - DNA, 487 bp, Homo sapiens
  misc_feature: HIJSMM301BEU9S.4.51.E07.1.454.light.4.raw
agcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctatctgtgtctccaggggaaagagccaccctctcctgcagggccagtcagagtgttaggagcaacttagcctggtaccagcataaacctggccaggctcccaggctcctcatctatggtgcatccaccagggccactggtatcccagccacgttcagtggcaggtgggtctgggacacagttcactctcaccatcagcagcctgcagtctgaagattttggagtttattactgtcagcagtataataactggcctctcactttcggcggagggaccaaggtggagatcaaacgaactgtggctgcacc

SEQ ID NO: 576327 - DNA, 503 bp, Homo sapiens
  misc_feature: HIJSMM301DMJF8.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggctgccccctcggtcta

SEQ ID NO: 576328 - DNA, 505 bp, Homo sapiens; identical to SEQ ID NO: 546412
  misc_feature: HIJSMM301BMA7V.22.21.B10.1.454.light.4.raw

SEQ ID NO: 576329 - DNA, 497 bp, Homo sapiens
  misc_feature: HIJSMM301AGYSO.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatacaaacgaactgtggctgcaccactctgtcttcatt

SEQ ID NO: 576330 - DNA, 477 bp, Homo sapiens; identical to SEQ ID NO: 535122
  misc_feature: HIJSMM301DYFRA.26.72.G06.1.454.light.4.raw

SEQ ID NO: 576331 - DNA, 488 bp, Homo sapiens
  misc_feature: HIJSMM301EIC1E.49.25.C03.1.454.light.4.raw
agtcgagagacacgaccggtgctcgatttagtagtgtagatttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgtaac

SEQ ID NO: 576332 - DNA, 383 bp, Homo sapiens; identical to SEQ ID NO: 544997
  misc_feature: HIJSMM301CSJOT.13.37.D04.1.454.light.4.raw

SEQ ID NO: 576333 - DNA, 498 bp, Homo sapiens
  misc_feature: HIJSMM301BUX4Z.48.32.C10.1.454.light.4.raw
agtatacatacacgaccggtgctcgatttagtatagacatcaacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccgaaggtggagatacaaacgaactgtggctgcaccatctgtt

SEQ ID NO: 576334 - DNA, 488 bp, Homo sapiens
  misc_feature: HIJSMM301BAXAW.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagttattactgtcagcagcgtagcaactggcctctcaccttcggcggagggaccaaggtggagatcaaacgaactgtggctgcacatctgt

SEQ ID NO: 576335 - DNA, 494 bp, Homo sapiens; identical to SEQ ID NO: 535090
  misc_feature: HIJSMM301EJA9A.27.78.H01.1.454.light.4.raw
  modified_base (403)..(403): a, c, t, g, unknown or other

SEQ ID NO: 576336 - DNA, 500 bp, Homo sapiens
  misc_feature: HIJSMM301DDP12.48.85.H08.1.454.light.4.raw
agtatacatacacgaccggtgctcgatttagtatcactcagtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctcgttcccg

SEQ ID NO: 576337 - DNA, 485 bp, Homo sapiens; identical to SEQ ID NO: 535606
  misc_feature: HIJSMM301EXAOF.47.46.E02.1.454.light.4.raw

SEQ ID NO: 576338 - DNA, 447 bp, Homo sapiens; identical to SEQ ID NO: 535201
  misc_feature: HIJSMM301AXVI0.18.9.A09.1.454.light.4.raw

SEQ ID NO: 576339 - DNA, 518 bp, Homo sapiens; identical to SEQ ID NO: 539372
  misc_feature: HIJSMM301BT571.7.86.H09.1.454.light.4.raw

SEQ ID NO: 576340 - DNA, 511 bp, Homo sapiens
  misc_feature: HIJSMM301DE83K.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcgagggaccaagctgaccgtcttaagtcagcccaaggctgccccctggtcactctgttcccaccctcct

SEQ ID NO: 576341 - DNA, 520 bp, Homo sapiens
  misc_feature: HIJSMM301B1TUZ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccgagggaccgaacggtaggaaggtacgaaacgaaacgtacgtggcgtgcaccactctgtcttctatcttcccgcccact

SEQ ID NO: 576342 - DNA, 505 bp, Homo sapiens
  misc_feature: HIJSMM301BMXK3.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggggaccgaaggtggagttcaaacgaactgtggctgcaccatctgtcttcatcttcccgccta

SEQ ID NO: 576343 - DNA, 462 bp, Homo sapiens; identical to SEQ ID NO: 537922
  misc_feature: HIJSMM301DSJ2U.10.9.A09.1.454.light.4.raw

SEQ ID NO: 576344 - DNA, 490 bp, Homo sapiens; identical to SEQ ID NO: 535234
  misc_feature: HIJSMM301DFBDL.17.21.B10.1.454.light.4.raw

SEQ ID NO: 576345 - DNA, 500 bp, Homo sapiens
  misc_feature: HIJSMM301AGTPK.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacggggctgactattattgtcaatcaacagacaccattggtacttatgtcttcggaactgcgaccaaggtcaccgtcctgggtcagcccaaggccaaccccactgtcactctcg

SEQ ID NO: 576346 - DNA, 507 bp, Homo sapiens
  misc_feature: HIJSMM301AUPDU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccaaggtggaaagtcaaacgaacctagtggctgcaccatctgtcttctatcttccccg

SEQ ID NO: 576347 - DNA, 512 bp, Homo sapiens
  misc_feature: HIJSMM301A5OW3.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccaacagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgccctt

SEQ ID NO: 576348 - DNA, 460 bp, Homo sapiens; identical to SEQ ID NO: 536053
  misc_feature: HIJSMM301D3ACS.22.28.C06.1.454.light.4.raw

SEQ ID NO: 576349 - DNA, 499 bp, Homo sapiens
  misc_feature: HIJSMM301BW0L3.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgcgaacggaccgaaggtggatatacagacgaacgtagtggcgtg

SEQ ID NO: 576350 - DNA, 506 bp, Homo sapiens; identical to SEQ ID NO: 539322
  misc_feature: HIJSMM301C17Q5.8.28.C06.1.454.light.4.raw

SEQ ID NO: 576351 - DNA, 495 bp, Homo sapiens; identical to SEQ ID NO: 556093
  misc_feature: HIJSMM301DA5IV.16.6.A06.1.454.light.4.raw

SEQ ID NO: 576352 - DNA, 499 bp, Homo sapiens; identical to SEQ ID NO: 575204
  misc_feature: HIJSMM301AZ1SA.5.24.C02.1.454.light.4.raw

SEQ ID NO: 576353 - DNA, 510 bp, Homo sapiens
  misc_feature: HIJSMM301D8BHE.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaacgggaccgaaggtaggaaagtacaaacgaactagtggctgcaccatctgtcttcatcttccccg

SEQ ID NO: 576354 - DNA, 493 bp, Homo sapiens; identical to SEQ ID NO: 544335
  misc_feature: HIJSMM301BQZXW.5.57.F02.1.454.light.4.raw

SEQ ID NO: 576355 - DNA, 486 bp, Homo sapiens; identical to SEQ ID NO: 543923
  misc_feature: HIJSMM301D1WHO.3.88.H11.1.454.light.4.raw

SEQ ID NO: 576356 - DNA, 485 bp, Homo sapiens; identical to SEQ ID NO: 545289
  misc_feature: HIJSMM301CUECJ.19.71.G05.1.454.light.4.raw

SEQ ID NO: 576357 - DNA, 479 bp, Homo sapiens
  misc_feature: HIJSMM301BDNIE.51.77.G11.1.454.light.4.raw
cgatcgtatacacgaccggtgctcgatttagctagtcactcaagggaaaggggagtcccaaccaggacacagcatggacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagacaaaaaccagggaaagcccctgagctcctgatcctcgatgcatccactttggaaacaggggtcccatcaaggttcagtggaagtggctctgggacactattttacttcaccatcagcagactgcagcctgaagatgttgcaacatattactgtcaacagtatcataatctcccgctcactttcggcggaggaccaaggtggagatcaaacgaactgtggctgcaccta

SEQ ID NO: 576358 - DNA, 506 bp, Homo sapiens; identical to SEQ ID NO: 535404
  misc_feature: HIJSMM301DI6JE.10.88.H11.1.454.light.4.raw

SEQ ID NO: 576359 - DNA, 491 bp, Homo sapiens; identical to SEQ ID NO: 550951
  misc_feature: HIJSMM301DNXN5.17.21.B10.1.454.light.4.raw

SEQ ID NO: 576360 - DNA, 418 bp, Homo sapiens; identical to SEQ ID NO: 536277
  misc_feature: HIJSMM301BB60Z.19.86.H09.1.454.light.4.raw

SEQ ID NO: 576361 - DNA, 501 bp, Homo sapiens
  misc_feature: HIJSMM301BQV65.51.26.C04.1.454.light.4.raw
cgatcgtatacacgaccggtgctcgatttagtctagcgactttgggtttgggggggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctgtcccg

SEQ ID NO: 576362 - DNA, 496 bp, Homo sapiens; identical to SEQ ID NO: 536933
  misc_feature: HIJSMM301B3JPE.51.28.C06.1.454.light.4.raw

SEQ ID NO: 576363 - DNA, 495 bp, Homo sapiens
  misc_feature: HIJSMM301CTC4J.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 576364 - DNA, 505 bp, Homo sapiens; identical to SEQ ID NO: 539292
  misc_feature: HIJSMM301CHEL5.19.85.H08.1.454.light.4.raw

SEQ ID NO: 576365 - DNA, 502 bp, Homo sapiens
  misc_feature: HIJSMM301C32JD.53.33.C11.1.454.light.4.raw
cgcgtatacacacgaccggtgctcgatttagagtgagctcgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggaggaccaaactgaccgtcctaggtcagcccaaggctgccccctcggtcactctcg

SEQ ID NO: 576366 - DNA, 491 bp, Homo sapiens; identical to SEQ ID NO: 547053
  misc_feature: HIJSMM301AQP3F.3.33.C11.1.454.light.4.raw

SEQ ID NO: 576367 - DNA, 479 bp, Homo sapiens
  misc_feature: HIJSMM301CUCEJ.51.86.H09.1.454.light.4.raw
cgatcgtatacacgaccggtgctcgatttagtgctatagacttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccgaacggtggagatcaagcgaacgtgtgg

SEQ ID NO: 576368 - DNA, 525 bp, Homo sapiens
  misc_feature: HIJSMM301B4F8X.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattatttattgttagttcatatacaaccagtgacacttgggtgttcggcggagggaccaggctgaccggtcctaggtcagcccaaggctgccccctcggtcactctcgttcccgccct

SEQ ID NO: 576369 - DNA, 502 bp, Homo sapiens; identical to SEQ ID NO: 536253
  misc_feature: HIJSMM301B68EL.21.22.B11.1.454.light.4.raw

SEQ ID NO: 576370 - DNA, 492 bp, Homo sapiens
  misc_feature: HIJSMM301A7MZR.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccgaaggtggaggatcaagcgaactgtggctgcaccatctgtctt

SEQ ID NO: 576371 - DNA, 492 bp, Homo sapiens
  misc_feature: HIJSMM301C9MTR.43.33.C11.1.454.light.4.raw
  modified_base (361)..(361): a, c, t, g, unknown or other
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttcnctcgtcatcactggtctacagtctgacgacggcgcaatgtacttctgtcaacactatgcctctcccccctacaatttcggtcaggggaccaagttgaacatcaatcgaactgtggctgcaccatctgtctt

SEQ ID NO: 576372 - DNA, 509 bp, Homo sapiens; identical to SEQ ID NO: 539359
  misc_feature: HIJSMM301DZKTN.47.85.H08.1.454.light.4.raw

SEQ ID NO: 576373 - DNA, 512 bp, Homo sapiens; identical to SEQ ID NO: 545961
  misc_feature: HIJSMM301B447O.14.78.H01.1.454.light.4.raw

SEQ ID NO: 576374 - DNA, 494 bp, Homo sapiens; identical to SEQ ID NO: 534994
  misc_feature: HIJSMM301DLJ77.27.78.H01.1.454.light.4.raw

SEQ ID NO: 576375 - DNA, 518 bp, Homo sapiens
  misc_feature: HIJSMM301DNLIY.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaaggctgaccgtcctaggtcagcccaaggctgccccctggtccactctgttccccctcctcctac

SEQ ID NO: 576376 - DNA, 511 bp, Homo sapiens
  misc_feature: HIJSMM301EPB25.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaacgggaccgaaggtggaaagtacaaacgaaactagtggctgcaccatctgtcttctatcttccccg

SEQ ID NO: 576377 - DNA, 500 bp, Homo sapiens
  misc_feature: HIJSMM301ASYYI.15.21.B10.1.454.light.4.raw
tctacgtagccacgaccggtgctcgatttagtgtcgtcgcaaggagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggattttgcaacttactattgtcaacaggctaacaagtttcctctcacttcggtcggagggaccgaaggtaggagtatacaaacgaactatggctgtcacca

SEQ ID NO: 576378 - DNA, 512 bp, Homo sapiens
  misc_feature: HIJSMM301EJM5C.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggcctgccccctc

SEQ ID NO: 576379 - DNA, 504 bp, Homo sapiens
  misc_feature: HIJSMM301AS1OG.4.39.D06.1.454.light.4.raw
agcactgtagcacgaccggtgctcgatttagtgacatctcgcagttccttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcgggcggagggaccaaactgaccgtcctaggttcagcccaaggctgccccctc

SEQ ID NO: 576380 - DNA, 505 bp, Homo sapiens; identical to SEQ ID NO: 536254
  misc_feature: HIJSMM301DWXX3.7.71.G05.1.454.light.4.raw

SEQ ID NO: 576381 - DNA, 500 bp, Homo sapiens
  misc_feature: HIJSMM301BIHED.26.26.C04.1.454.light.4.raw
agactatactcacgaccggtgctcgatttagtctagcgactttgggtttggggtgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaaactgtggctgcaccat

SEQ ID NO: 576382 - DNA, 481 bp, Homo sapiens; identical to SEQ ID NO: 544259
  misc_feature: HIJSMM301D1VAL.3.38.D05.1.454.light.4.raw

SEQ ID NO: 576383 - DNA, 497 bp, Homo sapiens
  misc_feature: HIJSMM301BAUNS.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgactgtgcttcaccatctgtcttcatt

SEQ ID NO: 576384 - DNA, 506 bp, Homo sapiens
  misc_feature: HIJSMM301DCQL7.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcta

SEQ ID NO: 576385 - DNA, 494 bp, Homo sapiens; identical to SEQ ID NO: 534994
  misc_feature: HIJSMM301CCO2F.27.78.H01.1.454.light.4.raw

SEQ ID NO: 576386 - DNA, 507 bp, Homo sapiens; identical to SEQ ID NO: 538313
  misc_feature: HIJSMM301BZVF7.7.71.G05.1.454.light.4.raw

SEQ ID NO: 576387 - DNA, 485 bp, Homo sapiens
  misc_feature: HIJSMM301BY4ZZ.43.64.F09.1.454.light.4.raw
tgtgagtagtcacgaccggtgctcgatttagcgcgtatacaagggggagtcagtctcagtcaggacacagcatggacatgagggtccccgctcagctcctggggctcctgctactctggctccgaggtggcagatgtgacatccagatgacccagtctccatcctccctgtctgcatctgtgggggacagagtcaccatcacttgtcgggcaagtcagtccgttaggcattatttaaattggtatcggcagagaccagggatggcccctcagctcatgatctacgctgcttccactctacaaattggggtcccatcaacgttcagtggcagtgggtctgggacatatttcactctcaccatcaccagtctggaacctgaagattttgcaacttacttctgccaacagacttacagtctccctctcactttcggcggagggaccacagtggagatcaaaggaactgtggctgcaccatctgttctt

SEQ ID NO: 576388 - DNA, 464 bp, Homo sapiens
  misc_feature: HIJSMM301DR7YV.26.37.D04.1.454.light.4.raw
agactatactcacgaccggtgctcgatttagtagcatactgttgggtttgggggaggaactgctcagttaggacccagccggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccgccatctgaagtatagtct

SEQ ID NO: 576389 - DNA, 455 bp, Homo sapiens; identical to SEQ ID NO: 535447
  misc_feature: HIJSMM301APADK.19.71.G05.1.454.light.4.raw

SEQ ID NO: 576390 - DNA, 508 bp, Homo sapiens; identical to SEQ ID NO: 552440
  misc_feature: HIJSMM301DEYMX.5.24.C02.1.454.light.4.raw

SEQ ID NO: 576391 - DNA, 484 bp, Homo sapiens; identical to SEQ ID NO: 535400
  misc_feature: HIJSMM301BLEOU.46.26.C04.1.454.light.4.raw

SEQ ID NO: 576392 - DNA, 444 bp, Homo sapiens
  misc_feature: HIJSMM301CA8IL.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtatctgat

SEQ ID NO: 576393 - DNA, 495 bp, Homo sapiens
  misc_feature: HIJSMM301CAVUF.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttactgtcagcagtatagtaactggcctccgtacacttttggccaggggaccaagctagaaatcaaacgaactgtggctgcaccatctgtcttcta

SEQ ID NO: 576394 - DNA, 498 bp, Homo sapiens; identical to SEQ ID NO: 537020
  misc_feature: HIJSMM301D6C93.26.26.C04.1.454.light.4.raw

SEQ ID NO: 576395 - DNA, 518 bp, Homo sapiens; identical to SEQ ID NO: 550282
  misc_feature: HIJSMM301EFQUW.41.19.B08.1.454.light.4.raw

SEQ ID NO: 576396 - DNA, 496 bp, Homo sapiens
  misc_feature: HIJSMM301B51YT.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcta

SEQ ID NO: 576397 - DNA, 509 bp, Homo sapiens
  misc_feature: HIJSMM301ANEDV.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncggggcgttcggccagggaccgaaggtaggaaagtacaaacgaactagtggctgcaccatctgtctttattcttcccgt

SEQ ID NO: 576398 - DNA, 507 bp, Homo sapiens; identical to SEQ ID NO: 565303
  misc_feature: HIJSMM301BCK3J.19.78.H01.1.454.light.4.raw

SEQ ID NO: 576399 - DNA, 495 bp, Homo sapiens; identical to SEQ ID NO: 537415
  misc_feature: HIJSMM301B80O7.4.27.C05.1.454.light.4.raw

SEQ ID NO: 576400 - DNA, 455 bp, Homo sapiens
  misc_feature: HIJSMM301EE96S.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattatttctgccagtcctatgacaacagcctgggtgccgtggtattcggcggagggaccaagctgaccgtcctaggtcagcccaaggctgccccctcggtcactctgttccccaccctcctcacgcgtatgt

SEQ ID NO: 576401 - DNA, 497 bp, Homo sapiens
  misc_feature: HIJSMM301DUT6V.51.7.A07.1.454.light.4.raw
cgatcgtatacacgaccggtgctcgatttagcacgtgtcgcagggggcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggatttactcatctctgggctccagtctgaggatgaggctgactattacttgtttgatttggcacagcagcgcttgggtattcggcgggggaccaacgtgaccgtcctaggtcagccaaggctcgcccctcggt

SEQ ID NO: 576402 - DNA, 482 bp, Homo sapiens
  misc_feature: HIJSMM301EST80.10.3.A03.1.454.light.4.raw
catagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagccccgaaactcctgatccatactgcctccactttggcaagtggggtcccatcaaggttcagcggcagtggagctgggacagagttcactctcagtatcagcagcctgcagcctgatgattttgcaacctattattgtcaacaatatgacacttatccattctctttcggccctgggaccaaagtggattccaaacgaactgtggctgcaccatctgtcttcatcttcccgccatctgacactact

SEQ ID NO: 576403 - DNA, 506 bp, Homo sapiens; identical to SEQ ID NO: 539721
  misc_feature: HIJSMM301CPF2X.3.79.H02.1.454.light.4.raw

SEQ ID NO: 576404 - DNA, 507 bp, Homo sapiens; identical to SEQ ID NO: 557429
  misc_feature: HIJSMM301ASNXI.15.59.F04.1.454.light.4.raw

SEQ ID NO: 576405 - DNA, 485 bp, Homo sapiens; identical to SEQ ID NO: 535652
  misc_feature: HIJSMM301B80ZX.19.71.G05.1.454.light.4.raw

SEQ ID NO: 576406 - DNA, 486 bp, Homo sapiens
  misc_feature: HIJSMM301DRE1I.4.41.D08.1.454.light.4.raw
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactccctgatctatggtgcatcaagtctgcaaagtggggtcccatcgaggttcagaggcagtggatctgggacagatttcactctcaccatcagcggcctgcagcctgaagattatgcaacttactattgtcagagtttctaattctttcccgcgcacgtttggcctaggggaccaaggtagagatcaacgaactgtggctgcaccat

SEQ ID NO: 576407 - DNA, 497 bp, Homo sapiens; identical to SEQ ID NO: 536376
  misc_feature: HIJSMM301CTCBI.22.9.A09.1.454.light.4.raw

SEQ ID NO: 576408 - DNA, 354 bp, Homo sapiens; identical to SEQ ID NO: 535026
  misc_feature: HIJSMM301DS789.19.22.B11.1.454.light.4.raw

SEQ ID NO: 576409 - DNA, 488 bp, Homo sapiens
  misc_feature: HIJSMM301C5DIK.40.15.B04.1.454.light.4.raw
tctagcgactcacgaccggtgctcgatttagacagtatatatccgcgggaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgttggcaaccaaggagcaacttggctgcagcagcaccagggccaccctcccaaagtcctatccgacaggaataacaaccggccctcagggatctcagagagaatatctgcatccaggtcaggaaacacagcctccctgaccattactggactccagcctgaggacgaggctgactattactgttcagcatggacggcagcctcagtgaatgggtgttcggcggagggaccaaactgtcgtcctaggtcagcccaaggctcg

SEQ ID NO: 576410 - DNA, 518 bp, Homo sapiens
  misc_feature: HIJSMM301AG4HF.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggaggggaccgaaactgaccgtcctaggtcagcccaaggctgccccctccggtcactctcg

SEQ ID NO: 576411 - DNA, 472 bp, Homo sapiens; identical to SEQ ID NO: 536302
  misc_feature: HIJSMM301CHGXU.18.76.G10.1.454.light.4.raw

SEQ ID NO: 576412 - DNA, 488 bp, Homo sapiens; identical to SEQ ID NO: 537260
  misc_feature: HIJSMM301ECXOF.47.70.G04.1.454.light.4.raw

SEQ ID NO: 576413 - DNA, 512 bp, Homo sapiens
  misc_feature: HIJSMM301BEVRC.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatcccccgatcgcttcatgggctccagttctggggctgaccgctacctcaccatctccaacctccagtctgacgatgaggctgagtatcactgtggagagagccacacaattgatggccaagacggttgggtgttcggcggagggaccaaggctgaccgtcctaggtcagccaaggctgccccctcggtcactctgttcccaccctcctcgctacgt

SEQ ID NO: 576414 - DNA, 487 bp, Homo sapiens; identical to SEQ ID NO: 535583
  misc_feature: HIJSMM301BAVHO.22.73.G07.1.454.light.4.raw

SEQ ID NO: 576415 - DNA, 485 bp, Homo sapiens; identical to SEQ ID NO: 535363
  misc_feature: HIJSMM301EYX7Z.17.26.C04.1.454.light.4.raw

SEQ ID NO: 576416 - DNA, 513 bp, Homo sapiens
  misc_feature: HIJSMM301DB2RN.49.23.C01.1.454.light.4.raw
agtcgagagacacgaccggtgctcgatttagtacacgtgattagggattgggggggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagccaaggctgccccctcggtcactctcgttcccaccctcct

SEQ ID NO: 576417 - DNA, 503 bp, Homo sapiens; identical to SEQ ID NO: 562029
  misc_feature: HIJSMM301B9N95.21.22.B11.1.454.light.4.raw

SEQ ID NO: 576418 - DNA, 497 bp, Homo sapiens
  misc_feature: HIJSMM301AEX9R.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtccccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtcttcta

SEQ ID NO: 576419 - DNA, 505 bp, Homo sapiens
  misc_feature: HIJSMM301CNC0B.10.39.D06.1.454.light.4.raw
catagtagtgcacgaccggtgctcgatttagtgacatctcgggcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtgggggtcttcggcggagggaccaagctgaccgtcctaagtcagcccaaggctgccccctcggtca

SEQ ID NO: 576420 - DNA, 494 bp, Homo sapiens; identical to SEQ ID NO: 534994
  misc_feature: HIJSMM301CJLAJ.27.78.H01.1.454.light.4.raw

SEQ ID NO: 576421 - DNA, 376 bp, Homo sapiens; identical to SEQ ID NO: 562942
  misc_feature: HIJSMM301AQ3H6.40.9.A09.1.454.light.4.raw

SEQ ID NO: 576422 - DNA, 486 bp, Homo sapiens; identical to SEQ ID NO: 535458
  misc_feature: HIJSMM301BDEKP.7.75.G09.1.454.light.4.raw

SEQ ID NO: 576423 - DNA, 495 bp, Homo sapiens
  misc_feature: HIJSMM301CH7Q5.51.23.C01.1.454.light.4.raw
cgatcgtatacacgaccggtgctcgatttagtacacgtgattagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaacccactgt

SEQ ID NO: 576424 - DNA, 520 bp, Homo sapiens; identical to SEQ ID NO: 539176
  misc_feature: HIJSMM301BEL4W.27.23.C01.1.454.light.4.raw

SEQ ID NO: 576425 - DNA, 507 bp, Homo sapiens
  misc_feature: HIJSMM301EOVY6.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctcccggctcctcatctctggtgcatcctccagggccactggttccccagccaggttcagtggcagtgggtctgggacaggagttcactctcaccatcagcagccttcagtctgaagattttgcagtttattactgtcaccagtatcataactggcctccgaagggggacttcggtccaagggaccaaggtggaattcaaccgaactgtggctgcacatctgtcttcatcttcccgt

SEQ ID NO: 576426 - DNA, 496 bp, Homo sapiens
  misc_feature: HIJSMM301BVOAS.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctccttcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcacttcggccaagggacacgactggaaattaacgaactgtggctgcaccatctgtcttcatcttccg

SEQ ID NO: 576427 - DNA, 485 bp, Homo sapiens; identical to SEQ ID NO: 536040
  misc_feature: HIJSMM301ANVWR.15.1.A01.1.454.light.4.raw

SEQ ID NO: 576428 - DNA, 302 bp, Homo sapiens; identical to SEQ ID NO: 564509
  misc_feature: HIJSMM301C4N6A.13.11.A11.1.454.light.4.raw

SEQ ID NO: 576429 - DNA, 488 bp, Homo sapiens
  misc_feature: HIJSMM301EJ8YA.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaaatcaaacgaactagtggctgcaccatctgtcttcta

SEQ ID NO: 576430 - DNA, 486 bp, Homo sapiens; identical to SEQ ID NO: 535385
  misc_feature: HIJSMM301EOSQR.19.71.G05.1.454.light.4.raw

SEQ ID NO: 576431 - DNA, 495 bp, Homo sapiens; identical to SEQ ID NO: 536055
  misc_feature: HIJSMM301CXVME.47.38.D05.1.454.light.4.raw

SEQ ID NO: 576432 - DNA, 488 bp, Homo sapiens
  misc_feature: HIJSMM301B2V4Q.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatcaaacgaaa

SEQ ID NO: 576433 - DNA, 497 bp, Homo sapiens
  misc_feature: HIJSMM301CP87U.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcgccaaggacgacgactggagattaaacgaaactagtggctgcaccatctgtcttctatt

SEQ ID NO: 576434 - DNA, 497 bp, Homo sapiens
  misc_feature: HIJSMM301EY4TM.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcggggggtctgggacagaattcactctcaccatcaccagcctgcagtctgaagattttgcagtctattactgtcagcaatataattactggctctctttcggcggggggaccaagctggagatcaaccgaactgtggctgcaccatctgtctt

SEQ ID NO: 576435 - DNA, 499 bp, Homo sapiens; identical to SEQ ID NO: 550763
  misc_feature: HIJSMM301ANXH8.19.78.H01.1.454.light.4.raw

SEQ ID NO: 576436 - DNA, 500 bp, Homo sapiens; identical to SEQ ID NO: 535310
  misc_feature: HIJSMM301DGX9Y.47.66.F11.1.454.light.4.raw

SEQ ID NO: 576437 - DNA, 476 bp, Homo sapiens; identical to SEQ ID NO: 538611
  misc_feature: HIJSMM301EI0EA.7.81.H04.1.454.light.4.raw

SEQ ID NO: 576438 - DNA, 488 bp, Homo sapiens; identical to SEQ ID NO: 540389
  misc_feature: HIJSMM301B465D.9.75.G09.1.454.light.4.raw

SEQ ID NO: 576439 - DNA, 478 bp, Homo sapiens; identical to SEQ ID NO: 565661
  misc_feature: HIJSMM301A0YRV.8.53.E09.1.454.light.4.raw

SEQ ID NO: 576440 - DNA, 500 bp, Homo sapiens; identical to SEQ ID NO: 540219
  misc_feature: HIJSMM301E378K.43.34.D01.1.454.light.4.raw

SEQ ID NO: 576441 - DNA, 508 bp, Homo sapiens; identical to SEQ ID NO: 537871
  misc_feature: HIJSMM301DW7Q4.8.33.C11.1.454.light.4.raw

SEQ ID NO: 576442 - DNA, 477 bp, Homo sapiens
  misc_feature: HIJSMM301CL2VG.51.78.H01.1.454.light.4.raw
cgatcgtatacacgaccggtgctcgatttagtgtgagtagtttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgtggctgcacca

SEQ ID NO: 576443 - DNA, 504 bp, Homo sapiens; identical to SEQ ID NO: 563048
  misc_feature: HIJSMM301CXULF.48.25.C03.1.454.light.4.raw

SEQ ID NO: 576444 - DNA, 495 bp, Homo sapiens; identical to SEQ ID NO: 545183
  misc_feature: HIJSMM301AWTR4.16.10.A10.1.454.light.4.raw

SEQ ID NO: 576445 - DNA, 509 bp, Homo sapiens; identical to SEQ ID NO: 539359
  misc_feature: HIJSMM301EGZJH.47.85.H08.1.454.light.4.raw

SEQ ID NO: 576446 - DNA, 479 bp, Homo sapiens; identical to SEQ ID NO: 537836
  misc_feature: HIJSMM301CEW6Q.11.11.A11.1.454.light.4.raw

SEQ ID NO: 576447 - DNA, 515 bp, Homo sapiens
  misc_feature: HIJSMM301BYRA8.48.55.E11.1.454.light.4.raw
  modified_base (502)..(502): a, c, t, g, unknown or other
agtatacatacacgaccggtgctcgatttagcactcgcacgttgggtttgggggctgtcaaactgattaggaactgacttccacctgcaggtcagggccaaggttatggggtcccaggttcacctcctcagcttcctcctcctttggatctctgataccagggcagaaacgacactcacgcagtctccagcattcatgtcagcgactccaggagacaaagtcaacatctcctgcaaaggcagccaagactttgatggtgatatgaactggtaccaacacagaccaggagaagctgctattttcattattcaagaggctactactctcgttcctggaatcgcacctcgattccgtggcagcggatttggaacagattttaccctcacaattaaaaacatagaatgtgaggatgctgcatattacttctgtctgcaatatgataagtcccccctacgtggacgttcggccaagggaccgaaggtggaaagtacaaacgaaaccngttggctgcacca

SEQ ID NO: 576448 - DNA, 501 bp, Homo sapiens
  misc_feature: HIJSMM301DAWUK.48.36.D03.1.454.light.4.raw
agtatacatacacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaacccactgt

SEQ ID NO: 576449 - DNA, 490 bp, Homo sapiens
  misc_feature: HIJSMM301CAJVY.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtggagatcaacgaacta

SEQ ID NO: 576450 - DNA, 443 bp, Homo sapiens; identical to SEQ ID NO: 546137
  misc_feature: HIJSMM301ECFH7.9.9.A09.1.454.light.4.raw

SEQ ID NO: 576451 - DNA, 513 bp, Homo sapiens
  misc_feature: HIJSMM301CW98H.9.14.B03.1.454.light.4.raw
  modified_base (507)..(507): a, c, t, g, unknown or other
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaaatatgtttattggtaccaacagaagtcaggccaggccccccttctagtcatctatgaggacgccaggcgaccctccgggatccctgagagaatctcgggctccagttcagggacagtggcccaccttgacgatcggtggggcccaggtgaagatgaagctgactacttctgttactcaacagacgacagtgcggatcatagaggatgttcggcggagggaccaagctgaccgtcctaggtcagcccaaggctgcccctcggtcactctgttcccncctcct

SEQ ID NO: 576452 - DNA, 497 bp, Homo sapiens; identical to SEQ ID NO: 535286
  misc_feature: HIJSMM301DV1LU.18.59.F04.1.454.light.4.raw

SEQ ID NO: 576453 - DNA, 501 bp, Homo sapiens
  misc_feature: HIJSMM301C4KLQ.43.42.D09.1.454.light.4.raw
tgtgagtagtcacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagcccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggtcggagggaccgaaggtggtagaatcaaacgaactgtggctgcaccatctgtcttcta

SEQ ID NO: 576454 - DNA, 508 bp, Homo sapiens
  misc_feature: HIJSMM301BFO4H.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggatcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccggggccacttcggccctgggaccaaattagagatcaaacgaactgtggctgcaccactctgtcttcatcttcccg

SEQ ID NO: 576455 - DNA, 454 bp, Homo sapiens; identical to SEQ ID NO: 534964
  misc_feature: HIJSMM301BUL5U.19.86.H09.1.454.light.4.raw

SEQ ID NO: 576456 - DNA, 506 bp, Homo sapiens
  misc_feature: HIJSMM301BUXUA.10.79.H02.1.454.light.4.raw
catagtagtgcacgaccggtgctcgatttagtgtcacacgaagggaaagggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcaggtggcaggtgggtctgggacagacttcactctcaccatcagcagactggagtctgaagtattttgctagtgttattattgtcagcaatatggtaggtcaccgtgggtacgttttggccgaggggaccgaagcgtggagatacaaacgaactgtggctgcacactctgtctt

SEQ ID NO: 576457 - DNA, 487 bp, Homo sapiens
  misc_feature: HIJSMM301DR3GK.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgcaacagtataatggttatgaatccacttttgtccaaggacaagctggagatcaaacgaactagtggctgcacca

SEQ ID NO: 576458 - DNA, 521 bp, Homo sapiens
  misc_feature: HIJSMM301APNIS.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccccactgtcactctgttcccaccctcct

SEQ ID NO: 576459 - DNA, 463 bp, Homo sapiens
  misc_feature: HIJSMM301DRCF9.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggcccttggaccagagtggacatgaaacgaa

SEQ ID NO: 576460 - DNA, 486 bp, Homo sapiens
  misc_feature: HIJSMM301AIMQK.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggtccaacgggaccgaacggtggaaatacaaacgaaactagtgg

SEQ ID NO: 576461 - DNA, 472 bp, Homo sapiens
  misc_feature: HIJSMM301AKT3F.51.78.H01.1.454.light.4.raw
cgatcgtatacacgaccggtgctcgatttagtgtgagtagtttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtgggtcccatcaaggttcagtggcagtggatctgggacagatttcactctcaccatcagcagtgtgcgacctgaagattttgcaacttactactgtcaacagagttacagtacccctcagctcacttttcggcggagggaccaaggtggagatcaaacgaa

SEQ ID NO: 576462 - DNA, 519 bp, Homo sapiens
  misc_feature: HIJSMM301EHJZD.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctctttctttggtggagcctacaggggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccg

SEQ ID NO: 576463 - DNA, 514 bp, Homo sapiens
  misc_feature: HIJSMM301ETH7J.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcattttgacaataataagcgaccctcagggattcctgaccgattctctggctccaagtctggcacgtcagccaccctgggcatcaccggactccagacgtggggacgaggccgattattactgcggaacatgggatagcagcctgagtactgtgataatcggcggagggaccaagctgaccgtcctaggtcagcccaaggcctcgccccctcggtcactctcgtccccta

SEQ ID NO: 576464 - DNA, 460 bp, Homo sapiens; identical to SEQ ID NO: 537107
  misc_feature: HIJSMM301DHD9D.22.28.C06.1.454.light.4.raw

SEQ ID NO: 576465 - DNA, 492 bp, Homo sapiens; identical to SEQ ID NO: 541395
  misc_feature: HIJSMM301CD0LR.21.47.E03.1.454.light.4.raw

SEQ ID NO: 576466 - DNA, 472 bp, Homo sapiens; identical to SEQ ID NO: 536302
  misc_feature: HIJSMM301BEBZ0.18.76.G10.1.454.light.4.raw

SEQ ID NO: 576467 - DNA, 495 bp, Homo sapiens
  misc_feature: HIJSMM301ERHKS.41.16.B05.1.454.light.4.raw
tctatactatcacgaccggtgctcgatttagagctcacgtaagggggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttggccaggggaccaagctcgagatcaaacgaactgtggctgcaccatctgtcttcatcttcccg

SEQ ID NO: 576468 - DNA, 505 bp, Homo sapiens; identical to SEQ ID NO: 536254
  misc_feature: HIJSMM301CWHX7.7.71.G05.1.454.light.4.raw

SEQ ID NO: 576469 - DNA, 506 bp, Homo sapiens
  misc_feature: HIJSMM301DNI3P.47.83.H06.1.454.light.4.raw
agctcacgtacacgaccggtgctcgatttagatcacgtgcgtcgcgggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccggaccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgttcg

SEQ ID NO: 576470 - DNA, 500 bp, Homo sapiens; identical to SEQ ID NO: 539563
  misc_feature: HIJSMM301EQZ2J.8.2.A02.1.454.light.4.raw

SEQ ID NO: 576471 - DNA, 495 bp, Homo sapiens
  misc_feature: HIJSMM301BKC21.17.43.D10.1.454.light.4.raw
cgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcaggggcagtgggtctgggacagagttcactctcaccatcagcagcctgcagtctgaagattttgcagtttattactgtcagcactataataactggcccccggggggacgttcggccaagggaccgaaggtggagatcaaacgaactgtggctgcaccatctgtcttcat

SEQ ID NO: 576472 - DNA, 498 bp, Homo sapiens; identical to SEQ ID NO: 544540
  misc_feature: HIJSMM301B8547.41.20.B09.1.454.light.4.raw

SEQ ID NO: 576473 - DNA, 508 bp, Homo sapiens; identical to SEQ ID NO: 552440
  misc_feature: HIJSMM301CZN2K.5.24.C02.1.454.light.4.raw

SEQ ID NO: 576474 - DNA, 498 bp, Homo sapiens
  misc_feature: HIJSMM301BLO8D.22.15.B04.1.454.light.4.raw
acatacgcgtcacgaccggtgctcgatttagacagtatatatccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggctagtttattattgtcagcaatattatattccctcctcagacgttcgacaagggaccaaggtggaaatcaaaacgaactgtggctgctaa

SEQ ID NO: 576475 - DNA, 488 bp, Homo sapiens
  misc_feature: HIJSMM301CFZUV.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgctaatttattactgtcagcagtataataactggtggacgttcggccaagggaccaaggtagaaatcaaacgaactgtggctgcaccatctgt

SEQ ID NO: 576476 - DNA, 503 bp, Homo sapiens
  misc_feature: HIJSMM301DCCN0.15.1.A01.1.454.light.4.raw
  modified_base (449)..(449): a, c, t, g, unknown or other
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattccggnggagggaccaagctgaccgtcctgcgtcagccaaggctcgcccctcggtcactc

SEQ ID NO: 576477 - DNA, 494 bp, Homo sapiens; identical to SEQ ID NO: 535629
  misc_feature: HIJSMM301D7HIQ.4.27.C05.1.454.light.4.raw

SEQ ID NO: 576478 - DNA, 504 bp, Homo sapiens; identical to SEQ ID NO: 539083
  misc_feature: HIJSMM301CZ4Z8.8.19.B08.1.454.light.4.raw

SEQ ID NO: 576479 - DNA, 487 bp, Homo sapiens; identical to SEQ ID NO: 537220
  misc_feature: HIJSMM301C3BUN.16.53.E09.1.454.light.4.raw

SEQ ID NO: 576480 - DNA, 484 bp, Homo sapiens; identical to SEQ ID NO: 571496
  misc_feature: HIJSMM301AXZON.41.34.D01.1.454.light.4.raw

SEQ ID NO: 576481 - DNA, 487 bp, Homo sapiens; identical to SEQ ID NO: 558317
  misc_feature: HIJSMM301CU7JW.7.85.H08.1.454.light.4.raw

SEQ ID NO: 576482 - DNA, 521 bp, Homo sapiens; identical to SEQ ID NO: 538715
  misc_feature: HIJSMM301BIHFQ.27.23.C01.1.454.light.4.raw

SEQ ID NO: 576483 - DNA, 509 bp, Homo sapiens; identical to SEQ ID NO: 571138
  misc_feature: HIJSMM301BA9WJ.4.57.F02.1.454.light.4.raw

SEQ ID NO: 576484 - DNA, 486 bp, Homo sapiens; identical to SEQ ID NO: 535043
  misc_feature: HIJSMM301CC5W2.46.35.D02.1.454.light.4.raw

SEQ ID NO: 576485 - DNA, 486 bp, Homo sapiens; identical to SEQ ID NO: 535043
  misc_feature: HIJSMM301D2JAN.46.35.D02.1.454.light.4.raw

SEQ ID NO: 576486 - DNA, 463 bp, Homo sapiens; identical to SEQ ID NO: 535062
  misc_feature: HIJSMM301BCDUK.11.73.G07.1.454.light.4.raw

SEQ ID NO: 576487 - DNA, 492 bp, Homo sapiens; identical to SEQ ID NO: 539732
  misc_feature: HIJSMM301B8EM8.4.9.A09.1.454.light.4.raw

SEQ ID NO: 576488 - DNA, 506 bp, Homo sapiens
  misc_feature: HIJSMM301CIB1Q.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaccccactgtcta

SEQ ID NO: 576489 - DNA, 506 bp, Homo sapiens; identical to SEQ ID NO: 558084
  misc_feature: HIJSMM301DNMMO.3.37.D04.1.454.light.4.raw

SEQ ID NO: 576490 - DNA, 495 bp, Homo sapiens
  misc_feature: HIJSMM301EHWAV.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtggggtctggggacagacttcactctcaccatcagcagcctagagcctgaagatttcgcagtttattactgtcagcagcgtagcaactggctgatcaccttcggccaacggacgacgactggaggataaacgtaaactagtggctgcaccaat

SEQ ID NO: 576491 - DNA, 504 bp, Homo sapiens
  misc_feature: HIJSMM301APNEZ.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaattggtcatctatgaagacgacaaacgaccctccgggatccctgagagattctctggctccagctcagggactatggccaccttgactatcagtggggcccaagtggaggatgaagctgactactactgttactcaatagagaacagtgataattctgggtgttcggcggagggaccaaactgaccgtcctaggtcagcccaaggcctgccccctcggtcactctcgtt

SEQ ID NO: 576492 - DNA, 488 bp, Homo sapiens; identical to SEQ ID NO: 537673
  misc_feature: HIJSMM301ERH8H.12.31.C09.1.454.light.4.raw

SEQ ID NO: 576493 - DNA, 488 bp, Homo sapiens
  misc_feature: HIJSMM301EG2YH.43.36.D03.1.454.light.4.raw
  modified_base (392)..(392): a, c, t, g, unknown or other
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacngcctccaggctgaggatgcggcggtttatattgtcaacaatattttagtgctccgtaacacttttggccaggggaccaagttggagatcaaacgaa

SEQ ID NO: 576494 - DNA, 517 bp, Homo sapiens; identical to SEQ ID NO: 566011
  misc_feature: HIJSMM301BF2RO.10.28.C06.1.454.light.4.raw

SEQ ID NO: 576495 - DNA, 492 bp, Homo sapiens; identical to SEQ ID NO: 566790
  misc_feature: HIJSMM301CTJ04.52.82.H05.1.454.light.4.raw

SEQ ID NO: 576496 - DNA, 494 bp, Homo sapiens; identical to SEQ ID NO: 534992
  misc_feature: HIJSMM301D9E58.9.1.A01.1.454.light.4.raw

SEQ ID NO: 576497 - DNA, 490 bp, Homo sapiens; identical to SEQ ID NO: 549369
  misc_feature: HIJSMM301A6768.19.71.G05.1.454.light.4.raw

SEQ ID NO: 576498 - DNA, 510 bp, Homo sapiens
  misc_feature: HIJSMM301DESQL.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttaccttcctaagtagatcaaaaaccttccggtccaacgggacgacgactggagattaaacgtaactagtggcgtgcaccactctgtctt

SEQ ID NO: 576499 - DNA, 494 bp, Homo sapiens
  misc_feature: HIJSMM301CCYFD.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctggtcactctgttcccgcctcct

SEQ ID NO: 576500 - DNA, 478 bp, Homo sapiens; identical to SEQ ID NO: 535129
  misc_feature: HIJSMM301CHFZW.11.11.A11.1.454.light.4.raw

SEQ ID NO: 576501 - DNA, 513 bp, Homo sapiens; identical to SEQ ID NO: 562672
  misc_feature: HIJSMM301D5JEE.40.12.B01.1.454.light.4.raw

SEQ ID NO: 576502 - DNA, 492 bp, Homo sapiens
  misc_feature: HIJSMM301A1HB8.51.53.E09.1.454.light.4.raw
cgatcgtatacacgaccggtgctcgatttagagagagtgtgttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcggggacggaacagcgtacgccgtcgtcgcacgaccgagctcccgcccgtcg

SEQ ID NO: 576503 - DNA, 447 bp, Homo sapiens; identical to SEQ ID NO: 535201
  misc_feature: HIJSMM301BCZFW.18.9.A09.1.454.light.4.raw

SEQ ID NO: 576504 - DNA, 502 bp, Homo sapiens
  misc_feature: HIJSMM301CGUT6.9.53.E09.1.454.light.4.raw
tgatacgtctcacgaccggtgctcgatttagagagagtgtgttgggtttgggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgtccccccg

SEQ ID NO: 576505 - DNA, 484 bp, Homo sapiens; identical to SEQ ID NO: 566906
  misc_feature: HIJSMM301AW6CM.8.49.E05.1.454.light.4.raw

SEQ ID NO: 576506 - DNA, 476 bp, Homo sapiens; identical to SEQ ID NO: 537368
  misc_feature: HIJSMM301D1SQQ.7.83.H06.1.454.light.4.raw

SEQ ID NO: 576507 - DNA, 492 bp, Homo sapiens
  misc_feature: HIJSMM301ENBC1.27.78.H01.1.454.light.4.raw
  modified_base (462)..(462): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcatggaagctgaagatgctgcaacttattactgtcatcagagtacttacttacctcaagtgatcaccttcggccaagggacacgactgganattaaacgaactgtggctgcaccatctgtt

SEQ ID NO: 576508 - DNA, 497 bp, Homo sapiens; identical to SEQ ID NO: 535286
  misc_feature: HIJSMM301EF4GR.18.59.F04.1.454.light.4.raw

SEQ ID NO: 576509 - DNA, 464 bp, Homo sapiens; identical to SEQ ID NO: 536640
  misc_feature: HIJSMM301AVA3A.26.78.H01.1.454.light.4.raw

SEQ ID NO: 576510 - DNA, 488 bp, Homo sapiens; identical to SEQ ID NO: 545628
  misc_feature: HIJSMM301CLXE5.14.55.E11.1.454.light.4.raw

SEQ ID NO: 576511 - DNA, 444 bp, Homo sapiens; identical to SEQ ID NO: 535594
  misc_feature: HIJSMM301A5VTC.9.9.A09.1.454.light.4.raw

SEQ ID NO: 576512 - DNA, 495 bp, Homo sapiens; identical to SEQ ID NO: 535964
  misc_feature: HIJSMM301EL4LX.16.10.A10.1.454.light.4.raw

SEQ ID NO: 576513 - DNA, 500 bp, Homo sapiens; identical to SEQ ID NO: 535310
  misc_feature: HIJSMM301ESICU.47.66.F11.1.454.light.4.raw

SEQ ID NO: 576514 - DNA, 492 bp, Homo sapiens
  misc_feature: HIJSMM301A0G9Z.49.55.E11.1.454.light.4.raw
agtcgagagacacgaccggtgctcgatttagcactcgcacgttgggttggggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 576515 - DNA, 494 bp, Homo sapiens; identical to SEQ ID NO: 535629
  misc_feature: HIJSMM301D2VJT.4.27.C05.1.454.light.4.raw

SEQ ID NO: 576516 - DNA, 480 bp, Homo sapiens; identical to SEQ ID NO: 553003
  misc_feature: HIJSMM301DLPO2.11.76.G10.1.454.light.4.raw

SEQ ID NO: 576517 - DNA, 441 bp, Homo sapiens; identical to SEQ ID NO: 534971
  misc_feature: HIJSMM301BUVDO.11.3.A03.1.454.light.4.raw

SEQ ID NO: 576518 - DNA, 493 bp, Homo sapiens; identical to SEQ ID NO: 571077
  misc_feature: HIJSMM301C5QQT.16.6.A06.1.454.light.4.raw

SEQ ID NO: 576519 - DNA, 493 bp, Homo sapiens; identical to SEQ ID NO: 535770
  misc_feature: HIJSMM301D80J8.51.71.G05.1.454.light.4.raw

SEQ ID NO: 576520 - DNA, 484 bp, Homo sapiens; identical to SEQ ID NO: 540152
  misc_feature: HIJSMM301B051I.46.35.D02.1.454.light.4.raw

SEQ ID NO: 576521 - DNA, 500 bp, Homo sapiens
  misc_feature: HIJSMM301DBE7S.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtataatagttacccctggacgttcggtccaagggaccgagggtaggaaagtacaaacgaaactgtggctgcaccatctgtcttcatt

SEQ ID NO: 576522 - DNA, 501 bp, Homo sapiens; identical to SEQ ID NO: 537545
  misc_feature: HIJSMM301APZ54.49.69.G03.1.454.light.4.raw

SEQ ID NO: 576523 - DNA, 481 bp, Homo sapiens
  misc_feature: HIJSMM301BTOCK.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggcctgggaccaatgtggatatcaaacgaactagtggctgcaccatctgt

SEQ ID NO: 576524 - DNA, 502 bp, Homo sapiens
  misc_feature: HIJSMM301BXDZG.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaaggctgaccgtcctgcgtcagcccaaggctgccccctcggtcact

SEQ ID NO: 576525 - DNA, 443 bp, Homo sapiens
  misc_feature: HIJSMM301CJESS.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctggtcactctgttcccgccctcctcagacgtatca

SEQ ID NO: 576526 - DNA, 487 bp, Homo sapiens
  misc_feature: HIJSMM301DPASZ.41.10.A10.1.454.light.4.raw
tctatactatcacgaccggtgctcgatttagcgtcgatctcagggggcatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctcaaacgttcggccaagggaccaaggtggaaatcaaacgaactgtggctgcaccatctgtcttcatt

SEQ ID NO: 576527 - DNA, 520 bp, Homo sapiens
  misc_feature: HIJSMM301DE44F.41.19.B08.1.454.light.4.raw
tctatactatcacgaccggtgctcgatttagtgagtcagtaaggggggggtctcaggaggcagcgctctcgggacgtctccaccatggcctgggctctgctatccctcaccctcctcactcagggcacagggtcctgggcccagtctgccctgactcagcctgcctacgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccaccctcctcat

SEQ ID NO: 576528 - DNA, 491 bp, Homo sapiens
  misc_feature: HIJSMM301CUEF5.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatccaccttcggccaagggacacgactggagattaaacgaactgtgctgcaccatctgtcttcatt

SEQ ID NO: 576529 - DNA, 487 bp, Homo sapiens
  misc_feature: HIJSMM301A1ZU2.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcaccta

SEQ ID NO: 576530 - DNA, 509 bp, Homo sapiens
  misc_feature: HIJSMM301A9EK4.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccggggccacttcggcctcgggacaaacttagagatacaaacgaactagtggctgcaccactctgtcttctactcttcccgccta

SEQ ID NO: 576531 - DNA, 483 bp, Homo sapiens; identical to SEQ ID NO: 564488
  misc_feature: HIJSMM301B4UB8.51.41.D08.1.454.light.4.raw

SEQ ID NO: 576532 - DNA, 484 bp, Homo sapiens; identical to SEQ ID NO: 535441
  misc_feature: HIJSMM301DETE7.26.60.F05.1.454.light.4.raw

SEQ ID NO: 576533 - DNA, 487 bp, Homo sapiens; identical to SEQ ID NO: 549649
  misc_feature: HIJSMM301D6UPE.19.71.G05.1.454.light.4.raw

SEQ ID NO: 576534 - DNA, 480 bp, Homo sapiens; identical to SEQ ID NO: 535975
  misc_feature: HIJSMM301CH21Y.51.60.F05.1.454.light.4.raw

SEQ ID NO: 576535 - DNA, 449 bp, Homo sapiens
  misc_feature: HIJSMM301CXEKD.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagttatttggctgttcggcggcgggaccaagttcgaccgtcctacgtcacgcccaaggctcgccccctcggtcactctcgttcccaccctcctccactactatg

SEQ ID NO: 576536 - DNA, 487 bp, Homo sapiens
  misc_feature: HIJSMM301BPB2Y.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggcctccgtggacattcgggccaaggtaccaaggtggacatcagacgaactgtggctgcacc

SEQ ID NO: 576537 - DNA, 495 bp, Homo sapiens; identical to SEQ ID NO: 541961
  misc_feature: HIJSMM301CLIYS.21.27.C05.1.454.light.4.raw
  modified_base (198)..(198): a, c, t, g, unknown or other

SEQ ID NO: 576538 - DNA, 447 bp, Homo sapiens
  misc_feature: HIJSMM301EN3JB.18.9.A09.1.454.light.4.raw
tacgagtatgcacgaccggtgctcgatttagcgagacgcgcaggggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccacctcctccatactcgta

SEQ ID NO: 576539 - DNA, 486 bp, Homo sapiens; identical to SEQ ID NO: 535043
  misc_feature: HIJSMM301CRJEQ.46.35.D02.1.454.light.4.raw

SEQ ID NO: 576540 - DNA, 484 bp, Homo sapiens; identical to SEQ ID NO: 535400
  misc_feature: HIJSMM301DM11K.46.26.C04.1.454.light.4.raw

SEQ ID NO: 576541 - DNA, 496 bp, Homo sapiens
  misc_feature: HIJSMM301EFJ17.27.78.H01.1.454.light.4.raw
  modified_base (483)..(483): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcacccctcaccatcaatagcctggaagctgaagatgctgcaacttattactgtcatcagagttactactttacctcaagtgatcaccttcggccaagggacacgactggagaattaaacgaactgtgctncaccatctgtctt

SEQ ID NO: 576542 - DNA, 492 bp, Homo sapiens; identical to SEQ ID NO: 536010
  misc_feature: HIJSMM301DEGDF.10.20.B09.1.454.light.4.raw

SEQ ID NO: 576543 - DNA, 497 bp, Homo sapiens
  misc_feature: HIJSMM301BT1UU.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcgggcccagactatggatgaggctgactattactgtcaggcgtgggacagcaattctgtgattttcggcggagggaccaagttgaccgtcctaggtcagcccaaggctgccccctcggtcactcttccg

SEQ ID NO: 576544 - DNA, 521 bp, Homo sapiens; identical to SEQ ID NO: 539470
  misc_feature: HIJSMM301DX9P5.27.23.C01.1.454.light.4.raw

SEQ ID NO: 576545 - DNA, 500 bp, Homo sapiens; identical to SEQ ID NO: 547405
  misc_feature: HIJSMM301AFOP3.41.71.G05.1.454.light.4.raw

SEQ ID NO: 576546 - DNA, 518 bp, Homo sapiens; identical to SEQ ID NO: 539372
  misc_feature: HIJSMM301EI31J.7.86.H09.1.454.light.4.raw

SEQ ID NO: 576547 - DNA, 495 bp, Homo sapiens; identical to SEQ ID NO: 535486
  misc_feature: HIJSMM301BPXIH.26.72.G06.1.454.light.4.raw

SEQ ID NO: 576548 - DNA, 500 bp, Homo sapiens
  misc_feature: HIJSMM301BEWJB.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagatttgcagtgtattattgtcagcagtatggtagcgcaccgtacacttttggccaggggtccaagctggagatgaaacgaactgtggctgcaccatctgtcttcatcttccccg

SEQ ID NO: 576549 - DNA, 447 bp, Homo sapiens; identical to SEQ ID NO: 535020
  misc_feature: HIJSMM301D03IX.18.9.A09.1.454.light.4.raw

SEQ ID NO: 576550 - DNA, 496 bp, Homo sapiens
  misc_feature: HIJSMM301EK4SL.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagacgtcttatttataaggtctctgaccgggactctggggtcccagacagattcagcggcagtgggtcagacactgatttcacactgaaaatcagcagggtggaggctgaggatggtcggggtttacgtactgcatgcagggtacactctcggccgttcacttttggcctaggggaccaaacgtggagtatcagacgaactgtggctgca

SEQ ID NO: 576551 - DNA, 484 bp, Homo sapiens
  misc_feature: HIJSMM301AHLL2.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttatactgtcagcagtataataactggcctccgtacatgtacacttttggccaggggaccaacctggagat

SEQ ID NO: 576552 - DNA, 520 bp, Homo sapiens
  misc_feature: HIJSMM301BS7U8.27.23.C01.1.454.light.4.raw
agcgtcgtctcacgaccggtgctcgatttagtacacgtgattagggagttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccagggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 576553 - DNA, 500 bp, Homo sapiens; identical to SEQ ID NO: 536183
  misc_feature: HIJSMM301DXJ49.10.17.B06.1.454.light.4.raw

SEQ ID NO: 576554 - DNA, 419 bp, Homo sapiens; identical to SEQ ID NO: 543165
  misc_feature: HIJSMM301AR2FC.18.78.H01.1.454.light.4.raw

SEQ ID NO: 576555 - DNA, 481 bp, Homo sapiens
  misc_feature: HIJSMM301CCF2R.40.59.F04.1.454.light.4.raw
tctagcgactcacgaccggtgctcgatttagtacacacacttagggattgggggcctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagacccg

SEQ ID NO: 576556 - DNA, 485 bp, Homo sapiens; identical to SEQ ID NO: 539576
  misc_feature: HIJSMM301DFZJR.4.57.F02.1.454.light.4.raw

SEQ ID NO: 576557 - DNA, 487 bp, Homo sapiens
  misc_feature: HIJSMM301B018Y.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtactcccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcaccatctgtt

SEQ ID NO: 576558 - DNA, 505 bp, Homo sapiens; identical to SEQ ID NO: 536232
  misc_feature: HIJSMM301BBF3A.47.65.F10.1.454.light.4.raw

SEQ ID NO: 576559 - DNA, 497 bp, Homo sapiens
  misc_feature: HIJSMM301CB5OX.9.27.C05.1.454.light.4.raw
tgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctgggacagagttcactctcagcatcaacagcgtgcgggctgaagattttgtttttattattgtcagcagtatgataactggcctctgtggacgttcggccaagggaccaaggtggatgtcaaacgaactgtggctgcaccatctgtcttcat

SEQ ID NO: 576560 - DNA, 515 bp, Homo sapiens; identical to SEQ ID NO: 538805
  misc_feature: HIJSMM301A40IW.14.19.B08.1.454.light.4.raw

SEQ ID NO: 576561 - DNA, 494 bp, Homo sapiens; identical to SEQ ID NO: 535629
  misc_feature: HIJSMM301BBTRU.4.27.C05.1.454.light.4.raw

SEQ ID NO: 576562 - DNA, 521 bp, Homo sapiens
  misc_feature: HIJSMM301DLNFE.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgtttcggcggagggaccaggctgaccgtcctaggtcagcccaaggctgcccctcggtcactctgttcccaccct

SEQ ID NO: 576563 - DNA, 509 bp, Homo sapiens; identical to SEQ ID NO: 541829
  misc_feature: HIJSMM301DXYAH.17.28.C06.1.454.light.4.raw

SEQ ID NO: 576564 - DNA, 473 bp, Homo sapiens; identical to SEQ ID NO: 535262
  misc_feature: HIJSMM301ET2ZV.8.67.G01.1.454.light.4.raw

SEQ ID NO: 576565 - DNA, 488 bp, Homo sapiens
  misc_feature: HIJSMM301AD6G2.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggccagtcagagtattagtcactttttggcctggtatcagcagagaccagggaaagcccctaacctcctgatctacgatgcctccaatttggagggtgggtcccatcaaggttcagcggcagtggatctgggacagagtttactctcaccatcagcagcctgcagcctgatgattttgcaacttattactgccaacattatgtttcttctccgtggacgttcggccaaggaccaaggtggaaatcaaacgaactagtggctgcaccatctgtt

SEQ ID NO: 576566 - DNA, 517 bp, Homo sapiens; identical to SEQ ID NO: 536980
  misc_feature: HIJSMM301AFKPN.5.27.C05.1.454.light.4.raw

SEQ ID NO: 576567 - DNA, 517 bp, Homo sapiens
  misc_feature: HIJSMM301BRIB4.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctggccccctcggtcactctgttcccaccctcctcacg

SEQ ID NO: 576568 - DNA, 496 bp, Homo sapiens
  misc_feature: HIJSMM301CCW2I.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaacgtaggacatcaagcgaactgtggcgtgcgaccatctgtt

SEQ ID NO: 576569 - DNA, 503 bp, Homo sapiens; identical to SEQ ID NO: 543109
  misc_feature: HIJSMM301BETFU.19.78.H01.1.454.light.4.raw

SEQ ID NO: 576570 - DNA, 517 bp, Homo sapiens
  misc_feature: HIJSMM301BWB3W.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaacggtagggaaagtacaaaacgaaaccgtagtggtctgcaccaatctgtcttctatcttccccg

SEQ ID NO: 576571 - DNA, 505 bp, Homo sapiens; identical to SEQ ID NO: 536233
  misc_feature: HIJSMM301ANQHY.48.25.C03.1.454.light.4.raw

SEQ ID NO: 576572 - DNA, 505 bp, Homo sapiens
  misc_feature: HIJSMM301DTSC4.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttgggtgttcggcggagggacccaaaactgaccgtcctagggtcagcccaa

SEQ ID NO: 576573 - DNA, 479 bp, Homo sapiens; identical to SEQ ID NO: 535188
  misc_feature: HIJSMM301B1LUB.10.74.G08.1.454.light.4.raw

SEQ ID NO: 576574 - DNA, 486 bp, Homo sapiens; identical to SEQ ID NO: 551175
  misc_feature: HIJSMM301CQHAL.41.33.C11.1.454.light.4.raw

SEQ ID NO: 576575 - DNA, 490 bp, Homo sapiens; identical to SEQ ID NO: 538273
  misc_feature: HIJSMM301CE3U7.16.73.G07.1.454.light.4.raw

SEQ ID NO: 576576 - DNA, 493 bp, Homo sapiens
  misc_feature: HIJSMM301EKBTH.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagttttattactgtcaacaatattataataatccatttaatttcggcggagggaccaaggtggagatcaaacgaactgtggctgcaccatctgtcttcatcttcccgccta

SEQ ID NO: 576577 - DNA, 486 bp, Homo sapiens; identical to SEQ ID NO: 535043
  misc_feature: HIJSMM301B60ED.46.35.D02.1.454.light.4.raw

SEQ ID NO: 576578 - DNA, 496 bp, Homo sapiens; identical to SEQ ID NO: 538149
  misc_feature: HIJSMM301AX9HX.13.67.G01.1.454.light.4.raw

SEQ ID NO: 576579 - DNA, 445 bp, Homo sapiens; identical to SEQ ID NO: 555301
  misc_feature: HIJSMM301C7KH2.5.9.A09.1.454.light.4.raw

SEQ ID NO: 576580 - DNA, 484 bp, Homo sapiens; identical to SEQ ID NO: 536162
  misc_feature: HIJSMM301DOC24.13.59.F04.1.454.light.4.raw

SEQ ID NO: 576581 - DNA, 489 bp, Homo sapiens; identical to SEQ ID NO: 535139
  misc_feature: HIJSMM301DIIBP.14.55.E11.1.454.light.4.raw

SEQ ID NO: 576582 - DNA, 502 bp, Homo sapiens; identical to SEQ ID NO: 541971
  misc_feature: HIJSMM301DTJDH.4.39.D06.1.454.light.4.raw

SEQ ID NO: 576583 - DNA, 519 bp, Homo sapiens
  misc_feature: HIJSMM301DVXN2.13.53.E09.1.454.light.4.raw
  modified_base (501)..(501): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaacggtagggaaagtacaagacgaaaccgtgtaggctgcaccaactctnttcttctactcttcccgt

SEQ ID NO: 576584 - DNA, 496 bp, Homo sapiens
  misc_feature: HIJSMM301BRNLR.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactagtggctgcaccatctgtcttcta

SEQ ID NO: 576585 - DNA, 489 bp, Homo sapiens; identical to SEQ ID NO: 565291
  misc_feature: HIJSMM301ERFS1.49.45.E01.1.454.light.4.raw

SEQ ID NO: 576586 - DNA, 487 bp, Homo sapiens
  misc_feature: HIJSMM301CY0V0.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagccccg

SEQ ID NO: 576587 - DNA, 486 bp, Homo sapiens
  misc_feature: HIJSMM301EDM53.19.71.G05.1.454.light.4.raw
tactctcgtgcacgaccggtgctcgatttagtgtcgtcgcaagagagagggggaaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 576588 - DNA, 518 bp, Homo sapiens
  misc_feature: HIJSMM301BNVHI.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccgaggctgaccgtcctaggtcagcccaaggctgccccctcggtcactctgttccc

SEQ ID NO: 576589 - DNA, 495 bp, Homo sapiens; identical to SEQ ID NO: 535486
  misc_feature: HIJSMM301EO0YS.26.72.G06.1.454.light.4.raw

SEQ ID NO: 576590 - DNA, 492 bp, Homo sapiens
  misc_feature: HIJSMM301DEZKL.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctaactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatt

SEQ ID NO: 576591 - DNA, 486 bp, Homo sapiens; identical to SEQ ID NO: 537310
  misc_feature: HIJSMM301EXJ4A.15.28.C06.1.454.light.4.raw

SEQ ID NO: 576592 - DNA, 489 bp, Homo sapiens; identical to SEQ ID NO: 544582
  misc_feature: HIJSMM301DOVEQ.22.65.F10.1.454.light.4.raw

SEQ ID NO: 576593 - DNA, 507 bp, Homo sapiens; identical to SEQ ID NO: 535641
  misc_feature: HIJSMM301CNEUM.10.88.H11.1.454.light.4.raw

SEQ ID NO: 576594 - DNA, 510 bp, Homo sapiens
  misc_feature: HIJSMM301A7QIM.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcttgatttatgatgtcacttatcggccctcaggggtttcttatcgcttctctggctccaagtctggcaacacggcctccctgaccatctctgggctcctggctgaggacgaggctgattattactgcaactcacttacaacgaccgacacttgcgtattcggcggcgggaccaagctgaccgtcctaggtcagcccaaggctcgccccctcggtctacc

SEQ ID NO: 576595 - DNA, 500 bp, Homo sapiens; identical to SEQ ID NO: 548721
  misc_feature: HIJSMM301B35Y0.14.35.D02.1.454.light.4.raw

SEQ ID NO: 576596 - DNA, 496 bp, Homo sapiens; identical to SEQ ID NO: 541772
  misc_feature: HIJSMM301A0DB9.51.81.H04.1.454.light.4.raw

SEQ ID NO: 576597 - DNA, 513 bp, Homo sapiens; identical to SEQ ID NO: 538156
  misc_feature: HIJSMM301CXKFM.16.66.F11.1.454.light.4.raw

SEQ ID NO: 576598 - DNA, 494 bp, Homo sapiens; identical to SEQ ID NO: 534992
  misc_feature: HIJSMM301BSANR.9.1.A01.1.454.light.4.raw

SEQ ID NO: 576599 - DNA, 491 bp, Homo sapiens
  misc_feature: HIJSMM301C9U3K.17.25.C03.1.454.light.4.raw
cgtagactagcacgaccggtgctcgatttagtagtgtagatttgggtttggggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgctacttttggccgaggggaccaaagttgagatcaaacgaactgtggctgcaccatctgtt

SEQ ID NO: 576600 - DNA, 486 bp, Homo sapiens; identical to SEQ ID NO: 535917
  misc_feature: HIJSMM301A457B.3.10.A10.1.454.light.4.raw

SEQ ID NO: 576601 - DNA, 505 bp, Homo sapiens
  misc_feature: HIJSMM301D6SWX.48.79.H02.1.454.light.4.raw
agtatacatacacgaccggtgctcgatttagtgtcacacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggccgaaggaccgaacggtaggaaagtacaaacgaactacgtggcgtgcgacca

SEQ ID NO: 576602 - DNA, 495 bp, Homo sapiens
  misc_feature: HIJSMM301BLYYC.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagaattaaaggaactgtggctgcaccatctgtcttcatcttccccg

SEQ ID NO: 576603 - DNA, 495 bp, Homo sapiens
  misc_feature: HIJSMM301EZGMR.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttactcggtctacaacatgataatttccctccgtggacgttggccaagggaccaaggagcaaatcaaacgaactgtggctgcaccatctgtcttcatcttcccgccat

SEQ ID NO: 576604 - DNA, 477 bp, Homo sapiens
  misc_feature: HIJSMM301EKNIP.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagattttgttaagggaaagtaatgaagttaacactgtggatcaccttcggccaagggacacgactggagattaaaacgaactgtggctgcaccatctgtcttcatcttcccgccatctgaagtatagtct

SEQ ID NO: 576605 - DNA, 473 bp, Homo sapiens
  misc_feature: HIJSMM301AQ0WE.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtgggtcccatcaagattcagtggcagtggatctgggacagatttcactctcgccatcagtagtctgcaacctgatgattttgcaacttactactgtcaacagagttccactaccccaatcactttcggcctggactgaagtgcatatgaagagaactgtggctgca

SEQ ID NO: 576606 - DNA, 478 bp, Homo sapiens
  misc_feature: HIJSMM301A8963.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcatagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctg

SEQ ID NO: 576607 - DNA, 497 bp, Homo sapiens; identical to SEQ ID NO: 535664
  misc_feature: HIJSMM301CETGV.22.14.B03.1.454.light.4.raw

SEQ ID NO: 576608 - DNA, 500 bp, Homo sapiens; identical to SEQ ID NO: 540219
  misc_feature: HIJSMM301CMQWA.43.34.D01.1.454.light.4.raw

SEQ ID NO: 576609 - DNA, 487 bp, Homo sapiens
  misc_feature: HIJSMM301B9634.22.73.G07.1.454.light.4.raw
acatacgcgtcacgaccggtgctcgatttagctctacgctcagggggaggaactgctcagttaggaccaagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcaccatctgtt

SEQ ID NO: 576610 - DNA, 510 bp, Homo sapiens
  misc_feature: HIJSMM301CYZ7M.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcgcggaggaccaagttgaccgtcctaggtcagcccaaggctgccccctcggtcactctgttcccaccctcctcta

SEQ ID NO: 576611 - DNA, 499 bp, Homo sapiens
  misc_feature: HIJSMM301B191W.10.68.G02.1.454.light.4.raw
catagtagtgcacgaccggtgctcgattagtcgatagtgaagggaaaggggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagccaaggctgccccctcggtcact

SEQ ID NO: 576612 - DNA, 511 bp, Homo sapiens; identical to SEQ ID NO: 543656
  misc_feature: HIJSMM301AFHGI.15.86.H09.1.454.light.4.raw

SEQ ID NO: 576613 - DNA, 486 bp, Homo sapiens; identical to SEQ ID NO: 536323
  misc_feature: HIJSMM301CQW6A.10.2.A02.1.454.light.4.raw

SEQ ID NO: 576614 - DNA, 495 bp, Homo sapiens; identical to SEQ ID NO: 538920
  misc_feature: HIJSMM301BA4BK.47.64.F09.1.454.light.4.raw

SEQ ID NO: 576615 - DNA, 491 bp, Homo sapiens; identical to SEQ ID NO: 536693
  misc_feature: HIJSMM301DFL8M.19.83.H06.1.454.light.4.raw

SEQ ID NO: 576616 - DNA, 493 bp, Homo sapiens; identical to SEQ ID NO: 535047
  misc_feature: HIJSMM301EVQUP.16.53.E09.1.454.light.4.raw

SEQ ID NO: 576617 - DNA, 447 bp, Homo sapiens; identical to SEQ ID NO: 535020
  misc_feature: HIJSMM301DJ8D0.18.9.A09.1.454.light.4.raw

SEQ ID NO: 576618 - DNA, 483 bp, Homo sapiens; identical to SEQ ID NO: 535413
  misc_feature: HIJSMM301BTVJ3.26.78.H01.1.454.light.4.raw

SEQ ID NO: 576619 - DNA, 494 bp, Homo sapiens; identical to SEQ ID NO: 535680
  misc_feature: HIJSMM301DM60L.16.78.H01.1.454.light.4.raw

SEQ ID NO: 576620 - DNA, 490 bp, Homo sapiens; identical to SEQ ID NO: 541974
  misc_feature: HIJSMM301A5BGD.22.65.F10.1.454.light.4.raw

SEQ ID NO: 576621 - DNA, 483 bp, Homo sapiens; identical to SEQ ID NO: 545669
  misc_feature: HIJSMM301A5T0W.13.8.A08.1.454.light.4.raw

SEQ ID NO: 576622 - DNA, 493 bp, Homo sapiens
  misc_feature: HIJSMM301BXJBC.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcattcttcccgccat

SEQ ID NO: 576623 - DNA, 504 bp, Homo sapiens
  misc_feature: HIJSMM301EPKD7.9.12.B01.1.454.light.4.raw
  modified_base (422)..(422): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacngttttctcgggcgttcggccaagggaccaaggtggaaatacaaacgaaactgtggctgcaccatctgtcttcatcttccccg

SEQ ID NO: 576624 - DNA, 494 bp, Homo sapiens; identical to SEQ ID NO: 534992
  misc_feature: HIJSMM301BMXIL.9.1.A01.1.454.light.4.raw

SEQ ID NO: 576625 - DNA, 488 bp, Homo sapiens
  misc_feature: HIJSMM301D3SXM.48.68.G02.1.454.light.4.raw
agtatacatacacgaccggtgctcgatttagtcgatagtgaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 576626 - DNA, 511 bp, Homo sapiens
  misc_feature: HIJSMM301EMFJ7.48.56.F01.1.454.light.4.raw
agtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacacctgaccgttatcggtcagcccaaggctgccccctcggtcact

SEQ ID NO: 576627 - DNA, 488 bp, Homo sapiens; identical to SEQ ID NO: 538017
  misc_feature: HIJSMM301A072P.4.59.F04.1.454.light.4.raw

SEQ ID NO: 576628 - DNA, 497 bp, Homo sapiens
  misc_feature: HIJSMM301CFZNJ.26.78.H01.1.454.light.4.raw
  modified_base (486)..(486): a, c, t, g, unknown or other
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcgggagggaccgagggtgggagagtcagacgaaactgtggctgnaccactctgtt

SEQ ID NO: 576629 - DNA, 487 bp, Homo sapiens
  misc_feature: HIJSMM301CTHI5.49.57.F02.1.454.light.4.raw
agtcgagagacacgaccggtgctcgatttagctcgatatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagagtcaaacccg

SEQ ID NO: 576630 - DNA, 503 bp, Homo sapiens
  misc_feature: HIJSMM301C20EZ.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggaggggaccaaggctgaccgtcctaggtcagcccaaggctgccccctcggtcactctgttcccgccctcctcgctacgtaga

SEQ ID NO: 576631 - DNA, 510 bp, Homo sapiens
  misc_feature: HIJSMM301DJJZR.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggcccctctccctcactttcggcgggggaccgaaggtggagctcaaacgaactgtggctgcaccatctgtcttcatcttcccg

SEQ ID NO: 576632 - DNA, 487 bp, Homo sapiens; identical to SEQ ID NO: 541444
  misc_feature: HIJSMM301BUECP.19.71.G05.1.454.light.4.raw

SEQ ID NO: 576633 - DNA, 504 bp, Homo sapiens
  misc_feature: HIJSMM301EQFJ9.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggcggagggaccaaaggtggagatcaaacgaactgtggctgcaaccatctgtcttcatcttccccgccat

SEQ ID NO: 576634 - DNA, 491 bp, Homo sapiens
  misc_feature: HIJSMM301ARKCK.19.71.G05.1.454.light.4.raw
tactctcgtgcacgaccggtgctcgatttagtgtcgtcgcaagagagaggggggaggtacaacaggcaggcaggggcgagcaagaatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaaggtggataatcagacgaa

SEQ ID NO: 576635 - DNA, 416 bp, Homo sapiens; identical to SEQ ID NO: 545902
  misc_feature: HIJSMM301DO9HM.18.78.H01.1.454.light.4.raw

SEQ ID NO: 576636 - DNA, 499 bp, Homo sapiens
  misc_feature: HIJSMM301ARCHI.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagattcttcttaccctcggacgttcggtcgacgggaccgacggtcggagtgtcaagacgaacgtcgtggcgtgcaccactacttcg

SEQ ID NO: 576637 - DNA, 489 bp, Homo sapiens; identical to SEQ ID NO: 574098
  misc_feature: HIJSMM301AWHCT.47.70.G04.1.454.light.4.raw

SEQ ID NO: 576638 - DNA, 444 bp, Homo sapiens; identical to SEQ ID NO: 534993
  misc_feature: HIJSMM301CGG6Z.5.9.A09.1.454.light.4.raw

SEQ ID NO: 576639 - DNA, 486 bp, Homo sapiens; identical to SEQ ID NO: 537617
  misc_feature: HIJSMM301CO57T.10.53.E09.1.454.light.4.raw

SEQ ID NO: 576640 - DNA, 444 bp, Homo sapiens; identical to SEQ ID NO: 535027
  misc_feature: HIJSMM301BC3HA.8.73.G07.1.454.light.4.raw

SEQ ID NO: 576641 - DNA, 484 bp, Homo sapiens; identical to SEQ ID NO: 536162
  misc_feature: HIJSMM301CCEKV.13.59.F04.1.454.light.4.raw

SEQ ID NO: 576642 - DNA, 488 bp, Homo sapiens
  misc_feature: HIJSMM301DP6T3.52.27.C05.1.454.light.4.raw
cgcagtacgacacgaccggtgctcgatttagacgcgatcgaagggtttgggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaagtgggtcccgtcaaggttcagtggccgtggatctgggacagatttcactctcaccatcagcagtctcaacctgaagattttgcaatttctactgtcaacagagtgacaataccccctcagactttcggccctcgggaccagagtggatatcaaacgaactgtggctgcaccatctgtctt

SEQ ID NO: 576643 - DNA, 479 bp, Homo sapiens; identical to SEQ ID NO: 540947
  misc_feature: HIJSMM301A1Z6C.52.1.A01.1.454.light.4.raw

SEQ ID NO: 576644 - DNA, 493 bp, Homo sapiens; identical to SEQ ID NO: 543205
  misc_feature: HIJSMM301DR6QZ.51.6.A06.1.454.light.4.raw

SEQ ID NO: 576645 - DNA, 487 bp, Homo sapiens
  misc_feature: HIJSMM301CB11D.48.61.F06.1.454.light.4.raw
agtatacatacacgaccggtgctcgatttagctacgctctaagggaaaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcgccgaggaccgaacggtaggaagtacaaacgaa

SEQ ID NO: 576646 - DNA, 460 bp, Homo sapiens; identical to SEQ ID NO: 536053
  misc_feature: HIJSMM301CXRWE.22.28.C06.1.454.light.4.raw

SEQ ID NO: 576647 - DNA, 495 bp, Homo sapiens; identical to SEQ ID NO: 535821
  misc_feature: HIJSMM301BYWLA.3.31.C09.1.454.light.4.raw

SEQ ID NO: 576648 - DNA, 497 bp, Homo sapiens
  misc_feature: HIJSMM301DH4YD.9.3.A03.1.454.light.4.raw
tgatacgtctcacgaccggtgctcgatttagagagcgtcacagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttatgatgcatccaacagggccactggcgtcccagccaggttcagtggcagtgggtctgggacagacttcactctcaccatcagcagcctagagcctgaagattttgcattttattactgtcagcagcgtgccaagtggcttctcactttcggcggagggaccaaggtggagaccagacgaactgtggctgcaccatctgtcttcatcttccccg

SEQ ID NO: 576649 - DNA, 487 bp, Homo sapiens; identical to SEQ ID NO: 537079
  misc_feature: HIJSMM301ASW7W.14.55.E11.1.454.light.4.raw

SEQ ID NO: 576650 - DNA, 512 bp, Homo sapiens
  misc_feature: HIJSMM301EJ5S7.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactcttccg

SEQ ID NO: 576651 - DNA, 506 bp, Homo sapiens
  misc_feature: HIJSMM301CAD29.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccacgttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 576652 - DNA, 498 bp, Homo sapiens
  misc_feature: HIJSMM301BWJJK.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggtcggggggaccaaggtgaccgtcctaggtcagcccaaggcc

SEQ ID NO: 576653 - DNA, 494 bp, Homo sapiens
  misc_feature: HIJSMM301AFRSH.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaagctgaccgtcctcagtcagaccccg

SEQ ID NO: 576654 - DNA, 484 bp, Homo sapiens; identical to SEQ ID NO: 535211
  misc_feature: HIJSMM301DFH84.47.46.E02.1.454.light.4.raw

SEQ ID NO: 576655 - DNA, 516 bp, Homo sapiens
  misc_feature: HIJSMM301B7DA6.15.76.G10.1.454.light.4.raw
tctacgtagccacgaccggtgctcgatttagtcactcatacagggggcggccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccccaccctccgctactacg

SEQ ID NO: 576656 - DNA, 483 bp, Homo sapiens
  misc_feature: HIJSMM301CM0TZ.48.78.H01.1.454.light.4.raw
agtatacatacacgaccggtgctcgatttagtgtgagtagtttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagcccaaggcg

SEQ ID NO: 576657 - DNA, 504 bp, Homo sapiens; identical to SEQ ID NO: 548611
  misc_feature: HIJSMM301ATP7X.48.26.C04.1.454.light.4.raw

SEQ ID NO: 576658 - DNA, 454 bp, Homo sapiens; identical to SEQ ID NO: 534964
  misc_feature: HIJSMM301A5VH0.19.86.H09.1.454.light.4.raw

SEQ ID NO: 576659 - DNA, 488 bp, Homo sapiens; identical to SEQ ID NO: 537260
  misc_feature: HIJSMM301EVI92.47.70.G04.1.454.light.4.raw

SEQ ID NO: 576660 - DNA, 491 bp, Homo sapiens; identical to SEQ ID NO: 535194
  misc_feature: HIJSMM301AS2BV.26.78.H01.1.454.light.4.raw

SEQ ID NO: 576661 - DNA, 487 bp, Homo sapiens; identical to SEQ ID NO: 538190
  misc_feature: HIJSMM301BO3QH.47.70.G04.1.454.light.4.raw

SEQ ID NO: 576662 - DNA, 502 bp, Homo sapiens; identical to SEQ ID NO: 541971
  misc_feature: HIJSMM301C9DLO.4.39.D06.1.454.light.4.raw

SEQ ID NO: 576663 - DNA, 507 bp, Homo sapiens; identical to SEQ ID NO: 563344
  misc_feature: HIJSMM301BFI81.3.79.H02.1.454.light.4.raw

SEQ ID NO: 576664 - DNA, 497 bp, Homo sapiens; identical to SEQ ID NO: 546363
  misc_feature: HIJSMM301AW0M2.12.37.D04.1.454.light.4.raw

SEQ ID NO: 576665 - DNA, 515 bp, Homo sapiens
  misc_feature: HIJSMM301CV50K.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttccccaccctcctcgctacgtagac

SEQ ID NO: 576666 - DNA, 473 bp, Homo sapiens; identical to SEQ ID NO: 535262
  misc_feature: HIJSMM301EH4V7.8.67.G01.1.454.light.4.raw

SEQ ID NO: 576667 - DNA, 468 bp, Homo sapiens
  misc_feature: HIJSMM301EJOMB.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccaaggtggagatcaagcgaact

SEQ ID NO: 576668 - DNA, 485 bp, Homo sapiens; identical to SEQ ID NO: 536799
  misc_feature: HIJSMM301CJ95J.19.71.G05.1.454.light.4.raw

SEQ ID NO: 576669 - DNA, 491 bp, Homo sapiens
  misc_feature: HIJSMM301EDM8B.16.68.G02.1.454.light.4.raw
  modified_base (96)..(96): a, c, t, g, unknown or other
tgtactactccacgaccggtgctcgatttagtcgatagtgaagggaaagggggagtcagacccagtcaggacacagcatggacatgagggtccccnctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatt

SEQ ID NO: 576670 - DNA, 486 bp, Homo sapiens; identical to SEQ ID NO: 535385
  misc_feature: HIJSMM301EAMH6.19.71.G05.1.454.light.4.raw

SEQ ID NO: 576671 - DNA, 416 bp, Homo sapiens; identical to SEQ ID NO: 539343
  misc_feature: HIJSMM301EK5OJ.18.78.H01.1.454.light.4.raw

SEQ ID NO: 576672 - DNA, 492 bp, Homo sapiens
  misc_feature: HIJSMM301CV8TR.14.30.C08.1.454.light.4.raw
cgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaacttctgatctatgatgcaaccatttacaagatgggatcccatcaaggttcagtggcggtggatctggggcggatttcactctcaccatcagcagtctgcaacctgaagattttgcgacttactggtgtcaacagggttatcataacccgtacacttttggccaggggaccaagctggacatcatacgaactgtggctgcaccatctgtt

SEQ ID NO: 576673 - DNA, 454 bp, Homo sapiens; identical to SEQ ID NO: 534964
  misc_feature: HIJSMM301CKQO4.19.86.H09.1.454.light.4.raw

SEQ ID NO: 576674 - DNA, 468 bp, Homo sapiens
  misc_feature: HIJSMM301AQNNA.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctcaacgtgatgatgttgcaacatactattgtcagcaatatgattttgctcctcgagtgccacttttggcgggggaccaaggtggacatcaaagaa

SEQ ID NO: 576675 - DNA, 444 bp, Homo sapiens; identical to SEQ ID NO: 535594
  misc_feature: HIJSMM301A1S8G.9.9.A09.1.454.light.4.raw

SEQ ID NO: 576676 - DNA, 479 bp, Homo sapiens; identical to SEQ ID NO: 537163
  misc_feature: HIJSMM301ECTQL.13.73.G07.1.454.light.4.raw

SEQ ID NO: 576677 - DNA, 496 bp, Homo sapiens
  misc_feature: HIJSMM301D13CR.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggggtttattactgcatgcaagctctacaaactccttacactttttggccaggggaccaagctggagatcaaacgaactgtggc

SEQ ID NO: 576678 - DNA, 354 bp, Homo sapiens; identical to SEQ ID NO: 535026
  misc_feature: HIJSMM301B5M5M.19.22.B11.1.454.light.4.raw

SEQ ID NO: 576679 - DNA, 481 bp, Homo sapiens
  misc_feature: HIJSMM301A39WJ.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatattttaccctcgtattttcggcccttgggaccacagtagatatcaaacgaactgtggctgcacc

SEQ ID NO: 576680 - DNA, 508 bp, Homo sapiens; identical to SEQ ID NO: 536388
  misc_feature: HIJSMM301BZKSG.11.57.F02.1.454.light.4.raw

SEQ ID NO: 576681 - DNA, 496 bp, Homo sapiens; identical to SEQ ID NO: 561102
  misc_feature: HIJSMM301A2E32.2.49.E05.1.454.light.4.raw

SEQ ID NO: 576682 - DNA, 505 bp, Homo sapiens; identical to SEQ ID NO: 535503
  misc_feature: HIJSMM301EQ5C5.8.28.C06.1.454.light.4.raw

SEQ ID NO: 576683 - DNA, 546 bp, Homo sapiens
  misc_feature: HIJSMM301BJFRT.14.67.G01.1.454.light.4.raw
  modified_base (517)..(517): a, c, t, g, unknown or other
cgtctagtaccacgaccggtgctcgatttagagtatacatattgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttanccccgttacatcttcccgccatctgagta

SEQ ID NO: 576684 - DNA, 389 bp, Homo sapiens; identical to SEQ ID NO: 540091
  misc_feature: HIJSMM301AFLG2.21.40.D07.1.454.light.4.raw

SEQ ID NO: 576685 - DNA, 508 bp, Homo sapiens; identical to SEQ ID NO: 565391
  misc_feature: HIJSMM301AZQ6U.5.58.F03.1.454.light.4.raw

SEQ ID NO: 576686 - DNA, 501 bp, Homo sapiens; identical to SEQ ID NO: 539237
  misc_feature: HIJSMM301BCL5E.4.39.D06.1.454.light.4.raw

SEQ ID NO: 576687 - DNA, 483 bp, Homo sapiens; identical to SEQ ID NO: 535413
  misc_feature: HIJSMM301BAP5Z.26.78.H01.1.454.light.4.raw

SEQ ID NO: 576688 - DNA, 502 bp, Homo sapiens
  misc_feature: HIJSMM301C3QED.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgtcactttcggcggaggtgccactttcggcggagggaccaaaatagaggtcaaacgaactagtggctgcaccatctgtcttcat

SEQ ID NO: 576689 - DNA, 499 bp, Homo sapiens
  misc_feature: HIJSMM301B5WDU.14.59.F04.1.454.light.4.raw
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaatcagcagagtggagctgaggatgttggggtttattactgcatgcaagctctacaaactcgaacgttcggccaagggaccgaaggtggaaatcaaacgaactgtggctgcaccatctgt

SEQ ID NO: 576690 - DNA, 503 bp, Homo sapiens; identical to SEQ ID NO: 538884
  misc_feature: HIJSMM301CCIZE.27.78.H01.1.454.light.4.raw

SEQ ID NO: 576691 - DNA, 485 bp, Homo sapiens; identical to SEQ ID NO: 535606
  misc_feature: HIJSMM301EJN51.47.46.E02.1.454.light.4.raw

SEQ ID NO: 576692 - DNA, 507 bp, Homo sapiens; identical to SEQ ID NO: 541461
  misc_feature: HIJSMM301APDOQ.11.57.F02.1.454.light.4.raw

SEQ ID NO: 576693 - DNA, 509 bp, Homo sapiens
  misc_feature: HIJSMM301A8DO3.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctcgtccccccg

SEQ ID NO: 576694 - DNA, 485 bp, Homo sapiens; identical to SEQ ID NO: 536576
  misc_feature: HIJSMM301BLLAS.46.35.D02.1.454.light.4.raw

SEQ ID NO: 576695 - DNA, 492 bp, Homo sapiens; identical to SEQ ID NO: 535939
  misc_feature: HIJSMM301BD6M0.13.5.A05.1.454.light.4.raw

SEQ ID NO: 576696 - DNA, 447 bp, Homo sapiens; identical to SEQ ID NO: 535201
  misc_feature: HIJSMM301DN3AM.18.9.A09.1.454.light.4.raw

SEQ ID NO: 576697 - DNA, 499 bp, Homo sapiens
  misc_feature: HIJSMM301CTRCQ.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccc

SEQ ID NO: 576698 - DNA, 509 bp, Homo sapiens
  misc_feature: HIJSMM301BQ8RZ.4.37.D04.1.454.light.4.raw
agcactgtagcacgaccggtgctcgatttagtagcatactgttgggtttgggggtgggctcaggaggcagagctctgggaatctcaccatggcctggacccctctcctgctccccctcctcactttctgcacagtctctgaggcctcctatgagctgacacagtcaccctcggtgtcagtgtccccaggacaaacggccaggatcacctgctctggagatgcattgaccaaaaaatatggttattggaaccagcagaagtcaggccaggcccctgtattggtcatctttgaggacagcaaccgaccctccgggatccctgagagattctctggctccacctcagggacaatggccaccttgactatcagtggggcccaggtggaggatgaagctgaatactactgttattcagcagacaacagtggtaagcagtggtattcggcggagggacaagtcgaccgtcctgggtcagcccaaggctcgccccctcggtcactctcgttcccta

SEQ ID NO: 576699 - DNA, 512 bp, Homo sapiens
  misc_feature: HIJSMM301EPOWB.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataattatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccc

SEQ ID NO: 576700 - DNA, 476 bp, Homo sapiens
  misc_feature: HIJSMM301CBSKW.53.83.H06.1.454.light.4.raw
cgcgtatacacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcgaccatcacctgttctggagacaaattgactgataaatatgctggctggtatcggcagaagccaggccagtcgcctgtgttggtcatctatcaggatagcaagcggccctcagggatccctgagcgattctctggctccaactctgggaacacagccactctgaccatcagcgggactcaggctatcgatgaggctgactattactgtcaggcgtgggacagccgcacctggggtattcgggcggagggaccaaggctgacccgtcctgagtcagccccg

SEQ ID NO: 576701 - DNA, 512 bp, Homo sapiens; identical to SEQ ID NO: 552536
  misc_feature: HIJSMM301DPO85.17.33.C11.1.454.light.4.raw

SEQ ID NO: 576702 - DNA, 490 bp, Homo sapiens; identical to SEQ ID NO: 544667
  misc_feature: HIJSMM301D34O9.12.23.C01.1.454.light.4.raw

SEQ ID NO: 576703 - DNA, 443 bp, Homo sapiens; identical to SEQ ID NO: 543663
  misc_feature: HIJSMM301EMK5T.2.76.G10.1.454.light.4.raw

SEQ ID NO: 576704 - DNA, 488 bp, Homo sapiens; identical to SEQ ID NO: 541868
  misc_feature: HIJSMM301ALPSY.14.55.E11.1.454.light.4.raw

SEQ ID NO: 576705 - DNA, 509 bp, Homo sapiens; identical to SEQ ID NO: 543266
  misc_feature: HIJSMM301CCNW2.17.33.C11.1.454.light.4.raw

SEQ ID NO: 576706 - DNA, 485 bp, Homo sapiens
  misc_feature: HIJSMM301BYUGA.41.5.A05.1.454.light.4.raw
tctatactatcacgaccggtgctcgatttagatagatagacagggcacgaccggtgctcgatttagatagatagacaggggggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttcccccttcaccttcggccaagggacacgtac

SEQ ID NO: 576707 - DNA, 490 bp, Homo sapiens
  misc_feature: HIJSMM301CMQMP.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgcctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggtccaggggaccaagctggagatcaggcgaacg

SEQ ID NO: 576708 - DNA, 518 bp, Homo sapiens
  misc_feature: HIJSMM301DLDCP.10.38.D05.1.454.light.4.raw
catagtagtgcacgaccggtgctcgatttagtatctgatagttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccgccct

SEQ ID NO: 576709 - DNA, 460 bp, Homo sapiens; identical to SEQ ID NO: 536053
  misc_feature: HIJSMM301CSVNR.22.28.C06.1.454.light.4.raw

SEQ ID NO: 576710 - DNA, 501 bp, Homo sapiens
  misc_feature: HIJSMM301EIV1O.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaagtggagatcaaacgaactgtggctgcaccta

SEQ ID NO: 576711 - DNA, 501 bp, Homo sapiens
  misc_feature: HIJSMM301AQA7L.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttccccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtctaggt

SEQ ID NO: 576712 - DNA, 503 bp, Homo sapiens
  misc_feature: HIJSMM301CCP5D.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagtattttgcactttattactgtcaccagcgtagcagctggcctcgaacgttcgccaggacgaaggtggacatcaagcgaacgtagtggctgcaccatctgtcttctatcttcccgccactc

SEQ ID NO: 576713 - DNA, 508 bp, Homo sapiens
  misc_feature: HIJSMM301A89BT.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagtattttactctcggcatccgcagcctgcagcctagaagtattttgcgacattattactgtacaacagtatagaaaatgtcccgctctacgtttcgggcgggggaccgaagggtggagttacaaacgaactgtggctgcaccatctgtcttcattcc

SEQ ID NO: 576714 - DNA, 487 bp, Homo sapiens
  misc_feature: HIJSMM301DTELI.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggtcaggggaccaagctggagatcaaacgaa

SEQ ID NO: 576715 - DNA, 513 bp, Homo sapiens; identical to SEQ ID NO: 545752
  misc_feature: HIJSMM301CQWZ3.17.33.C11.1.454.light.4.raw

SEQ ID NO: 576716 - DNA, 507 bp, Homo sapiens
  misc_feature: HIJSMM301B4OBM.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggaggccaggctgaccgtcctaagtcagcccaaggctgccccctc

SEQ ID NO: 576717 - DNA, 465 bp, Homo sapiens; identical to SEQ ID NO: 539935
  misc_feature: HIJSMM301C8I4W.3.20.B09.1.454.light.4.raw

SEQ ID NO: 576718 - DNA, 505 bp, Homo sapiens
  misc_feature: HIJSMM301C044Y.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactggtggagagagccacacaattgatggccaaaggacggttgggtgttcggcggagggaccaagctgaccgtcctaggtcagcccaaggctgccccctcggtcactctgttcccacctcctcg

SEQ ID NO: 576719 - DNA, 494 bp, Homo sapiens
  misc_feature: HIJSMM301DHSD5.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggtccaggggaccaagctggagatcaaacgaactgtgg

SEQ ID NO: 576720 - DNA, 505 bp, Homo sapiens; identical to SEQ ID NO: 536117
  misc_feature: HIJSMM301AKYKV.8.71.G05.1.454.light.4.raw

SEQ ID NO: 576721 - DNA, 498 bp, Homo sapiens
  misc_feature: HIJSMM301CW1CI.48.70.G04.1.454.light.4.raw
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactcttcaccatcagtagcctgcaggctgaagatgtggcagtttatactgtcaacatattattatactccgccgacgttcgccggggccgaacgtcggaatcaacgaactgtggctgcaccatct

SEQ ID NO: 576722 - DNA, 494 bp, Homo sapiens
  misc_feature: HIJSMM301AEIG5.52.86.H09.1.454.light.4.raw
cgcagtacgacacgaccggtgctcgatttagtgctatagacttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 576723 - DNA, 471 bp, Homo sapiens
  misc_feature: HIJSMM301CUR1N.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacagggtcccaccaaggttcagcggaagtggatctgggacagattttaatttcaccatcagcagcctccaacgtgatgatgttgcaacatactattgtcagcaatatgattttgctcctccgagtgccactttggtcggggggaccaaggtggacatcaaacgaa

SEQ ID NO: 576724 - DNA, 489 bp, Homo sapiens
  misc_feature: HIJSMM301CGSNO.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaagtcgggcctccggggtccctgacaggttcagtggcagtggatcaggcacagtatttacactagaaaatcagcagagtggaggctgaggatggttgggctctattattgcatgcaagctctacaacgtcccgctcactttcggcggacggaccgaaggtggagatacaacgaa

SEQ ID NO: 576725 - DNA, 494 bp, Homo sapiens; identical to SEQ ID NO: 534994
  misc_feature: HIJSMM301EKT7R.27.78.H01.1.454.light.4.raw

SEQ ID NO: 576726 - DNA, 476 bp, Homo sapiens
  misc_feature: HIJSMM301DDV7F.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagatctgcaacttattactgtcaacagagtaacagttaccctcccactttcggcggagggaccaaggtggagatcaaacgactagtggctgca

SEQ ID NO: 576727 - DNA, 498 bp, Homo sapiens
  misc_feature: HIJSMM301B1W49.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaaggctgaccgtcctgagtcagcccaaggctgccccctcggtcactctgtt

SEQ ID NO: 576728 - DNA, 483 bp, Homo sapiens
  misc_feature: HIJSMM301A43NK.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccagggaccaaggtcggaaatgagacgaactgtggctgcacc

SEQ ID NO: 576729 - DNA, 498 bp, Homo sapiens
  misc_feature: HIJSMM301AU9AS.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtgggaaatacaaacgaaactagtggctgcaccatctgtcttcat

SEQ ID NO: 576730 - DNA, 523 bp, Homo sapiens
  misc_feature: HIJSMM301C0S49.12.71.G05.1.454.light.4.raw
atacgacgtacacgaccggtgctcgatttagtgtcgtcgcaagagagaggggggggtcgacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgatttttggaaattttgacctagtctcctggtaccaacaataccccggcaagtccccaagttaatcatttatgagggcactaagcggccctcaggagtttctgatcgcttctctggctccaaggctggcgaccgggcctccctgacaatatctgggctccaggctgaggacgaggctcatttactactgctgctcatatggaggttatagcacttgggtggttcggcggcgggaccaaagtgaccgtcctaagtcagcccaaggctgccccctcggtcactctgttcccaccct

SEQ ID NO: 576731 - DNA, 496 bp, Homo sapiens; identical to SEQ ID NO: 572065
  misc_feature: HIJSMM301AGA6J.10.37.D04.1.454.light.4.raw

SEQ ID NO: 576732 - DNA, 523 bp, Homo sapiens
  misc_feature: HIJSMM301C5I63.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggtcggaggggaccaaacggctgaccggtccctaagttcagccccaaaggctgccccctcggtccaactctcg

SEQ ID NO: 576733 - DNA, 480 bp, Homo sapiens; identical to SEQ ID NO: 545225
  misc_feature: HIJSMM301DP4BW.43.12.B01.1.454.light.4.raw

SEQ ID NO: 576734 - DNA, 505 bp, Homo sapiens; identical to SEQ ID NO: 537881
  misc_feature: HIJSMM301AJHAG.9.12.B01.1.454.light.4.raw

SEQ ID NO: 576735 - DNA, 414 bp, Homo sapiens
  misc_feature: HIJSMM301EDJHW.40.36.D03.1.454.light.4.raw
tctagcgactcacgaccggtgctcgatttagctgcgtcacgatctctcttgggagttacccgattggagggcgttatccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccaacgtggaaatcaaacgaactgtggctgcaccatctgtcttcatcttcccgccatctgaagtcgctaga

SEQ ID NO: 576736 - DNA, 508 bp, Homo sapiens
  misc_feature: HIJSMM301DOPWL.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcact

SEQ ID NO: 576737 - DNA, 503 bp, Homo sapiens
  misc_feature: HIJSMM301DX8LA.51.14.B03.1.454.light.4.raw
cgatcgtatacacgaccggtgctcgatttagtgtgagtagttccgcggggaggagtcagaccccgtcgggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagtattttgcaactttattattgtcaacaggctaaaagttccctctcactttcggcggaggaccaaaggtagaaaaccaaacgaactgtggctgcaccatctgtcttcatcttccccg

SEQ ID NO: 576738 - DNA, 485 bp, Homo sapiens
  misc_feature: HIJSMM301B70V3.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaagggaccaaggtggatatcagacgaa

SEQ ID NO: 576739 - DNA, 491 bp, Homo sapiens; identical to SEQ ID NO: 539402
  misc_feature: HIJSMM301ESK6S.13.5.A05.1.454.light.4.raw

SEQ ID NO: 576740 - DNA, 508 bp, Homo sapiens
  misc_feature: HIJSMM301DIA90.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgacccatctcggggctccaggctgaggacgaggctgcttattactgcagctcatatacaaggagcaccactctcgtggtatttggtggagggaccaagctgaccgtcctaggtcagcccaaggctcgccccctcggt

SEQ ID NO: 576741 - DNA, 484 bp, Homo sapiens; identical to SEQ ID NO: 536162
  misc_feature: HIJSMM301B5VIX.13.59.F04.1.454.light.4.raw

SEQ ID NO: 576742 - DNA, 493 bp, Homo sapiens; identical to SEQ ID NO: 535770
  misc_feature: HIJSMM301D59A1.51.71.G05.1.454.light.4.raw

SEQ ID NO: 576743 - DNA, 494 bp, Homo sapiens; identical to SEQ ID NO: 535680
  misc_feature: HIJSMM301C9DBC.16.78.H01.1.454.light.4.raw

SEQ ID NO: 576744 - DNA, 498 bp, Homo sapiens; identical to SEQ ID NO: 548154
  misc_feature: HIJSMM301DK4C5.11.75.G09.1.454.light.4.raw

SEQ ID NO: 576745 - DNA, 466 bp, Homo sapiens; identical to SEQ ID NO: 541765
  misc_feature: HIJSMM301D89LJ.11.70.G04.1.454.light.4.raw

SEQ ID NO: 576746 - DNA, 509 bp, Homo sapiens; identical to SEQ ID NO: 539359
  misc_feature: HIJSMM301DC1GZ.47.85.H08.1.454.light.4.raw

SEQ ID NO: 576747 - DNA, 477 bp, Homo sapiens; identical to SEQ ID NO: 554966
  misc_feature: HIJSMM301A1YN0.12.1.A01.1.454.light.4.raw

SEQ ID NO: 576748 - DNA, 503 bp, Homo sapiens; identical to SEQ ID NO: 544567
  misc_feature: HIJSMM301DKN6L.41.35.D02.1.454.light.4.raw

SEQ ID NO: 576749 - DNA, 521 bp, Homo sapiens; identical to SEQ ID NO: 538715
  misc_feature: HIJSMM301ENXVF.27.23.C01.1.454.light.4.raw

SEQ ID NO: 576750 - DNA, 487 bp, Homo sapiens
  misc_feature: HIJSMM301AI3ZR.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccagggaccaaactggacatcaaacgaactagtggctgcaccatctgt

SEQ ID NO: 576751 - DNA, 495 bp, Homo sapiens; identical to SEQ ID NO: 563808
  misc_feature: HIJSMM301CI38U.40.57.F02.1.454.light.4.raw

SEQ ID NO: 576752 - DNA, 495 bp, Homo sapiens
  misc_feature: HIJSMM301AV0QZ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtcaaacaccttcggccgaaggacacgactggagattaaaggaactgtggctgcaccatctgtcttcatcttccccg

SEQ ID NO: 576753 - DNA, 508 bp, Homo sapiens; identical to SEQ ID NO: 537871
  misc_feature: HIJSMM301C8TE5.8.33.C11.1.454.light.4.raw

SEQ ID NO: 576754 - DNA, 485 bp, Homo sapiens; identical to SEQ ID NO: 535606
  misc_feature: HIJSMM301A3SON.47.46.E02.1.454.light.4.raw

SEQ ID NO: 576755 - DNA, 486 bp, Homo sapiens; identical to SEQ ID NO: 553608
  misc_feature: HIJSMM301AE6ZT.11.12.B01.1.454.light.4.raw

SEQ ID NO: 576756 - DNA, 490 bp, Homo sapiens
  misc_feature: HIJSMM301C70ZH.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgacccattactggactccagcctgaggacgaggctgactattactgctcagcatgggacaggcggcctcaggacttatgtcttcggaactgggacccacgttaccgtcctaggtcagaccccg

SEQ ID NO: 576757 - DNA, 495 bp, Homo sapiens
  misc_feature: HIJSMM301BP25L.40.38.D05.1.454.light.4.raw
tctagcgactcacgaccggtgctcgatttagtatctgatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaac

SEQ ID NO: 576758 - DNA, 501 bp, Homo sapiens; identical to SEQ ID NO: 568432
  misc_feature: HIJSMM301EAAPE.2.49.E05.1.454.light.4.raw

SEQ ID NO: 576759 - DNA, 497 bp, Homo sapiens
  misc_feature: HIJSMM301BDLRW.16.86.H09.1.454.light.4.raw
tgtactactccacgaccggtgctcgatttagtgctatagacttgggtttgggggcgtggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagttgacgttggtagttataattatgtctcctggtaccaacagtacccaggcaaagcccccaaactcatgatttatgagggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaagg

SEQ ID NO: 576760 - DNA, 504 bp, Homo sapiens
  misc_feature: HIJSMM301A5HET.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccaccgtgaccgtcttaggtcagcccaaggctgccccctcggtcacc

SEQ ID NO: 576761 - DNA, 494 bp, Homo sapiens; identical to SEQ ID NO: 534994
  misc_feature: HIJSMM301AU208.27.78.H01.1.454.light.4.raw

SEQ ID NO: 576762 - DNA, 509 bp, Homo sapiens
  misc_feature: HIJSMM301DFMJL.16.1.A01.1.454.light.4.raw
  modified_base (492)..(492): a, c, t, g, unknown or other
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatataggaagtagtactactcctgtggttttcggcggagggaccaagctgaccggtcctaggtcagcccaacgcgnccccctcggtccactct

SEQ ID NO: 576763 - DNA, 493 bp, Homo sapiens; identical to SEQ ID NO: 571339
  misc_feature: HIJSMM301BUBRE.10.72.G06.1.454.light.4.raw

SEQ ID NO: 576764 - DNA, 454 bp, Homo sapiens; identical to SEQ ID NO: 536943
  misc_feature: HIJSMM301B8JPZ.19.86.H09.1.454.light.4.raw

SEQ ID NO: 576765 - DNA, 492 bp, Homo sapiens; identical to SEQ ID NO: 534967
  misc_feature: HIJSMM301D8PXE.47.64.F09.1.454.light.4.raw

SEQ ID NO: 576766 - DNA, 496 bp, Homo sapiens
  misc_feature: HIJSMM301CC7LF.27.78.H01.1.454.light.4.raw
  modified_base (492)..(492): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatccgtnttct

SEQ ID NO: 576767 - DNA, 486 bp, Homo sapiens
  misc_feature: HIJSMM301DDP08.4.34.D01.1.454.light.4.raw
agcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttataaagagttcggcggagggaccaagctgaccgtcctaggtcagcccaaggctcg

SEQ ID NO: 576768 - DNA, 488 bp, Homo sapiens
  misc_feature: HIJSMM301EQML4.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatacaacgaaa

SEQ ID NO: 576769 - DNA, 506 bp, Homo sapiens; identical to SEQ ID NO: 557854
  misc_feature: HIJSMM301ETQA8.7.71.G05.1.454.light.4.raw

SEQ ID NO: 576770 - DNA, 484 bp, Homo sapiens; identical to SEQ ID NO: 536393
  misc_feature: HIJSMM301AHHQV.4.41.D08.1.454.light.4.raw

SEQ ID NO: 576771 - DNA, 502 bp, Homo sapiens; identical to SEQ ID NO: 539314
  misc_feature: HIJSMM301EF9QQ.21.81.H04.1.454.light.4.raw

SEQ ID NO: 576772 - DNA, 486 bp, Homo sapiens; identical to SEQ ID NO: 554021
  misc_feature: HIJSMM301BHBJR.40.83.H06.1.454.light.4.raw

SEQ ID NO: 576773 - DNA, 503 bp, Homo sapiens
  misc_feature: HIJSMM301EQAAA.48.85.H08.1.454.light.4.raw
agtatacatacacgaccggtgctcgatttagtatcactcagtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatccagggggacccaggccttggatgaggctgactatcactgtcaggcgtgggacagcaacactgcgattttcggcgggggaccgaggctgaccgtcggcggtcagcccaaggctcgccccctcggtcactctcgtcccta

SEQ ID NO: 576774 - DNA, 503 bp, Homo sapiens
  misc_feature: HIJSMM301AJEHS.48.38.D05.1.454.light.4.raw
agtatacatacacgaccggtgctcgatttagtatctgatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatgggcccgaggtggacgatgaggctgactactactgttctcaacagacagtagtggtgatcgagggctgttcgggcggagggaccaagctgaccgtcctaagtcagcccaaggctgccccctcggtcactctcg

SEQ ID NO: 576775 - DNA, 377 bp, Homo sapiens; identical to SEQ ID NO: 536071
  misc_feature: HIJSMM301AT790.40.9.A09.1.454.light.4.raw

SEQ ID NO: 576776 - DNA, 494 bp, Homo sapiens
  misc_feature: HIJSMM301APXDQ.17.55.E11.1.454.light.4.raw
cgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaggtggaggatcaaacgaactagtgg

SEQ ID NO: 576777 - DNA, 512 bp, Homo sapiens
  misc_feature: HIJSMM301CT5CE.48.56.F01.1.454.light.4.raw
agtatacatacacgaccggtgctcgatttagcagacgtctgaacacacaaaggggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctgccccctcggtcactctcg

SEQ ID NO: 576778 - DNA, 506 bp, Homo sapiens
  misc_feature: HIJSMM301DLOVI.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactcttgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtcta

SEQ ID NO: 576779 - DNA, 513 bp, Homo sapiens; identical to SEQ ID NO: 535719
  misc_feature: HIJSMM301AMXN1.17.33.C11.1.454.light.4.raw

SEQ ID NO: 576780 - DNA, 515 bp, Homo sapiens
  misc_feature: HIJSMM301BGEHD.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccacggaccgaacggtaggaagtactaagacgaacctagtggcgtgcgaccactactgtcttctactcttcccgt

SEQ ID NO: 576781 - DNA, 489 bp, Homo sapiens
  misc_feature: HIJSMM301D9MVV.52.34.D01.1.454.light.4.raw
cgcagtacgacacgaccggtgctcgatttagatcgtctgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcgggcggagggaccaaggttcgaccgttcctaggtcaggcccaaggctc

SEQ ID NO: 576782 - DNA, 454 bp, Homo sapiens; identical to SEQ ID NO: 535005
  misc_feature: HIJSMM301A704R.19.86.H09.1.454.light.4.raw

SEQ ID NO: 576783 - DNA, 507 bp, Homo sapiens
  misc_feature: HIJSMM301DK1NX.22.21.B10.1.454.light.4.raw
acatacgcgtcacgaccggtgctcgatttagtgtcgtcgcaaggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactctgggtgttcggcggagggacaagctgaccgtcctaggtcagcccaaggctgccccctccggtcactccttcg

SEQ ID NO: 576784 - DNA, 494 bp, Homo sapiens; identical to SEQ ID NO: 551626
  misc_feature: HIJSMM301A8Y6K.11.59.F04.1.454.light.4.raw

SEQ ID NO: 576785 - DNA, 489 bp, Homo sapiens
  misc_feature: HIJSMM301CA6DE.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtacgtctgcgacagagttcactctcaccatcaacagcctgcagtctgaagattttgcagtttattactgtcagcagtatcatgactggccgctcaccttcggccaagggacacgactggagattaaacgaactgtggctgcaccatctgtt

SEQ ID NO: 576786 - DNA, 492 bp, Homo sapiens
  misc_feature: HIJSMM301EBRQL.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagttaataactacctctcactttcggaggagggaccagggtggaggatcaaacgaactgtggctgcaccatctgtcttcta

SEQ ID NO: 576787 - DNA, 488 bp, Homo sapiens; identical to SEQ ID NO: 540342
  misc_feature: HIJSMM301CD7O0.43.33.C11.1.454.light.4.raw

SEQ ID NO: 576788 - DNA, 517 bp, Homo sapiens; identical to SEQ ID NO: 546084
  misc_feature: HIJSMM301CI943.47.53.E09.1.454.light.4.raw

SEQ ID NO: 576789 - DNA, 521 bp, Homo sapiens
  misc_feature: HIJSMM301A82UM.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccgggacagcagtgctgaccaggtggtagttcggcggacgggacccgacctcgccgtaaaaaacgttggtcgacgcccgaacggcgtcgccccctccggtccgtacc

SEQ ID NO: 576790 - DNA, 505 bp, Homo sapiens; identical to SEQ ID NO: 558635
  misc_feature: HIJSMM301DHKZ8.8.42.D09.1.454.light.4.raw

SEQ ID NO: 576791 - DNA, 501 bp, Homo sapiens; identical to SEQ ID NO: 546822
  misc_feature: HIJSMM301BVDEB.4.39.D06.1.454.light.4.raw

SEQ ID NO: 576792 - DNA, 479 bp, Homo sapiens; identical to SEQ ID NO: 535188
  misc_feature: HIJSMM301EFCVP.10.74.G08.1.454.light.4.raw

SEQ ID NO: 576793 - DNA, 479 bp, Homo sapiens
  misc_feature: HIJSMM301A8FL9.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaactcactttcggccctcggacgtgagtagcatatgaagagaactagtggctgca

SEQ ID NO: 576794 - DNA, 513 bp, Homo sapiens; identical to SEQ ID NO: 547639
  misc_feature: HIJSMM301CI0AT.43.59.F04.1.454.light.4.raw

SEQ ID NO: 576795 - DNA, 484 bp, Homo sapiens
  misc_feature: HIJSMM301D3F1S.51.79.H02.1.454.light.4.raw
cgatcgtatacacgaccggtgctcgatttagtgtcacacgaagggaaaggggggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctgccccctc

SEQ ID NO: 576796 - DNA, 484 bp, Homo sapiens; identical to SEQ ID NO: 535400
  misc_feature: HIJSMM301B9C1D.46.26.C04.1.454.light.4.raw

SEQ ID NO: 576797 - DNA, 501 bp, Homo sapiens; identical to SEQ ID NO: 536867
  misc_feature: HIJSMM301AFKMV.5.86.H09.1.454.light.4.raw

SEQ ID NO: 576798 - DNA, 504 bp, Homo sapiens; identical to SEQ ID NO: 535561
  misc_feature: HIJSMM301BZWV5.4.57.F02.1.454.light.4.raw

SEQ ID NO: 576799 - DNA, 493 bp, Homo sapiens; identical to SEQ ID NO: 556851
  misc_feature: HIJSMM301BUKD5.52.10.A10.1.454.light.4.raw

SEQ ID NO: 576800 - DNA, 511 bp, Homo sapiens
  misc_feature: HIJSMM301DFZWK.48.38.D05.1.454.light.4.raw
agtatacatacacgaccggtgctcgatttagtatctgatagttgggtttgggggtgggctcaggaggcagagctctgggaatctcaccatggcctggacccctctcctgctccccctcctcactttctgcacagtctctgaggcctcctctgagctgacacaagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgcct

SEQ ID NO: 576801 - DNA, 494 bp, Homo sapiens; identical to SEQ ID NO: 535276
  misc_feature: HIJSMM301C0JHO.16.6.A06.1.454.light.4.raw

SEQ ID NO: 576802 - DNA, 501 bp, Homo sapiens; identical to SEQ ID NO: 536142
  misc_feature: HIJSMM301BELC4.15.1.A01.1.454.light.4.raw

SEQ ID NO: 576803 - DNA, 513 bp, Homo sapiens
  misc_feature: HIJSMM301A1N6W.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaacggtggagatcaaacgaaactagtggcgtgcaccaactctgtt

SEQ ID NO: 576804 - DNA, 496 bp, Homo sapiens; identical to SEQ ID NO: 565908
  misc_feature: HIJSMM301B0K88.26.72.G06.1.454.light.4.raw

SEQ ID NO: 576805 - DNA, 509 bp, Homo sapiens
  misc_feature: HIJSMM301ETQD3.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtctaggtcagcccaaggccaacccactgtcactctcg

SEQ ID NO: 576806 - DNA, 463 bp, Homo sapiens; identical to SEQ ID NO: 535062
  misc_feature: HIJSMM301EKMI2.11.73.G07.1.454.light.4.raw

SEQ ID NO: 576807 - DNA, 493 bp, Homo sapiens; identical to SEQ ID NO: 540880
  misc_feature: HIJSMM301B5IXZ.40.81.H04.1.454.light.4.raw

SEQ ID NO: 576808 - DNA, 488 bp, Homo sapiens
  misc_feature: HIJSMM301DV29C.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtcttca

SEQ ID NO: 576809 - DNA, 510 bp, Homo sapiens
  misc_feature: HIJSMM301CUYT3.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccatcct

SEQ ID NO: 576810 - DNA, 497 bp, Homo sapiens
  misc_feature: HIJSMM301DRMMC.48.42.D09.1.454.light.4.raw
agtatacatacacgaccggtgctcgatttagacacatacgcagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccg

SEQ ID NO: 576811 - DNA, 508 bp, Homo sapiens
  misc_feature: HIJSMM301EK39C.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggcctcgccccctcggtccta

SEQ ID NO: 576812 - DNA, 496 bp, Homo sapiens; identical to SEQ ID NO: 535541
  misc_feature: HIJSMM301DPFDF.3.33.C11.1.454.light.4.raw

SEQ ID NO: 576813 - DNA, 463 bp, Homo sapiens; identical to SEQ ID NO: 535062
  misc_feature: HIJSMM301AMBU5.11.73.G07.1.454.light.4.raw

SEQ ID NO: 576814 - DNA, 485 bp, Homo sapiens
  misc_feature: HIJSMM301AJAQA.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaacgaactgtggctgcaccatctgtctt

SEQ ID NO: 576815 - DNA, 452 bp, Homo sapiens
  misc_feature: HIJSMM301EFW7F.19.86.H09.1.454.light.4.raw
  modified_base (448)..(448): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgacgtcctaagtcagcgcaaggctgccccctcggtcactctgttcccacctcctccacganagta

SEQ ID NO: 576816 - DNA, 493 bp, Homo sapiens
  misc_feature: HIJSMM301CH6OZ.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactagaaaatcagcagggtggaggctgaggatgtcggggtttactactgcatgcagggtacactctggccgttctacttttggccaggggaccaaactggatatcagacgaactgtggctgcta

SEQ ID NO: 576817 - DNA, 494 bp, Homo sapiens; identical to SEQ ID NO: 542031
  misc_feature: HIJSMM301B0IBM.12.23.C01.1.454.light.4.raw

SEQ ID NO: 576818 - DNA, 492 bp, Homo sapiens; identical to SEQ ID NO: 536010
  misc_feature: HIJSMM301ES1CD.10.20.B09.1.454.light.4.raw

SEQ ID NO: 576819 - DNA, 496 bp, Homo sapiens; identical to SEQ ID NO: 535109
  misc_feature: HIJSMM301BNFYT.16.78.H01.1.454.light.4.raw

SEQ ID NO: 576820 - DNA, 500 bp, Homo sapiens; identical to SEQ ID NO: 545976
  misc_feature: HIJSMM301EMSE4.14.23.C01.1.454.light.4.raw

SEQ ID NO: 576821 - DNA, 486 bp, Homo sapiens; identical to SEQ ID NO: 536261
  misc_feature: HIJSMM301EV5KI.26.55.E11.1.454.light.4.raw

SEQ ID NO: 576822 - DNA, 501 bp, Homo sapiens; identical to SEQ ID NO: 565108
  misc_feature: HIJSMM301B0BBJ.52.87.H10.1.454.light.4.raw

SEQ ID NO: 576823 - DNA, 460 bp, Homo sapiens; identical to SEQ ID NO: 540069
  misc_feature: HIJSMM301D1ETR.11.86.H09.1.454.light.4.raw

SEQ ID NO: 576824 - DNA, 512 bp, Homo sapiens; identical to SEQ ID NO: 542831
  misc_feature: HIJSMM301C2REH.43.19.B08.1.454.light.4.raw

SEQ ID NO: 576825 - DNA, 488 bp, Homo sapiens; identical to SEQ ID NO: 541987
  misc_feature: HIJSMM301CPH1L.8.12.B01.1.454.light.4.raw

SEQ ID NO: 576826 - DNA, 494 bp, Homo sapiens
  misc_feature: HIJSMM301ENOJC.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgaccgtcttaggtcagcccaaggct

SEQ ID NO: 576827 - DNA, 503 bp, Homo sapiens
  misc_feature: HIJSMM301B3P0D.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccct

SEQ ID NO: 576828 - DNA, 472 bp, Homo sapiens
  misc_feature: HIJSMM301A36I1.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacttcggccaagggaccaaggtggaaatcaaacgaa

SEQ ID NO: 576829 - DNA, 474 bp, Homo sapiens
  misc_feature: HIJSMM301DBLJO.40.23.C01.1.454.light.4.raw
tctagcgactcacgaccggtgctcgatttagtacacgtgattagggattggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 576830 - DNA, 482 bp, Homo sapiens
  misc_feature: HIJSMM301C7ZXX.5.34.D01.1.454.light.4.raw
atcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcgccaaggacacgactggagattaaacgaactgtggctgcaccta

SEQ ID NO: 576831 - DNA, 506 bp, Homo sapiens
  misc_feature: HIJSMM301AF3CG.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagccctccctgaccatcagtgggctccggtccgaggatgaggctgactattactgtgcatcacggggacgcaacatgggatgacaatctgagcgggttgggtgttcggcggagggaccaaactgaccgtcctaggtcagccccaa

SEQ ID NO: 576832 - DNA, 485 bp, Homo sapiens; identical to SEQ ID NO: 535501
  misc_feature: HIJSMM301CLPDM.3.10.A10.1.454.light.4.raw

SEQ ID NO: 576833 - DNA, 460 bp, Homo sapiens; identical to SEQ ID NO: 537107
  misc_feature: HIJSMM301C0RUQ.22.28.C06.1.454.light.4.raw

SEQ ID NO: 576834 - DNA, 485 bp, Homo sapiens; identical to SEQ ID NO: 538053
  misc_feature: HIJSMM301A0M8U.13.5.A05.1.454.light.4.raw

SEQ ID NO: 576835 - DNA, 505 bp, Homo sapiens; identical to SEQ ID NO: 536117
  misc_feature: HIJSMM301CVECV.8.71.G05.1.454.light.4.raw

SEQ ID NO: 576836 - DNA, 505 bp, Homo sapiens; identical to SEQ ID NO: 535503
  misc_feature: HIJSMM301BRMTH.8.28.C06.1.454.light.4.raw

SEQ ID NO: 576837 - DNA, 508 bp, Homo sapiens
  misc_feature: HIJSMM301EXJ8W.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcta

SEQ ID NO: 576838 - DNA, 513 bp, Homo sapiens
  misc_feature: HIJSMM301EFPOJ.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgacggaccgaacggtggaaagtacaagacgaaccgtagtggcgtgcaccactctgtcttctactcttccgt

SEQ ID NO: 576839 - DNA, 495 bp, Homo sapiens
  misc_feature: HIJSMM301BLOAZ.43.61.F06.1.454.light.4.raw
tgtgagtagtcacgaccggtgctcgatttagctacgctctaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtcactc

SEQ ID NO: 576840 - DNA, 488 bp, Homo sapiens; identical to SEQ ID NO: 558731
  misc_feature: HIJSMM301ADTS6.47.36.D03.1.454.light.4.raw

SEQ ID NO: 576841 - DNA, 490 bp, Homo sapiens; identical to SEQ ID NO: 543909
  misc_feature: HIJSMM301BBZIG.14.55.E11.1.454.light.4.raw

SEQ ID NO: 576842 - DNA, 499 bp, Homo sapiens
  misc_feature: HIJSMM301BP6NR.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgaccaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtca

SEQ ID NO: 576843 - DNA, 501 bp, Homo sapiens; identical to SEQ ID NO: 536867
  misc_feature: HIJSMM301B5Y7D.5.86.H09.1.454.light.4.raw

SEQ ID NO: 576844 - DNA, 488 bp, Homo sapiens
  misc_feature: HIJSMM301EOPII.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcgagccccg

SEQ ID NO: 576845 - DNA, 482 bp, Homo sapiens; identical to SEQ ID NO: 537007
  misc_feature: HIJSMM301CMG3B.41.34.D01.1.454.light.4.raw

SEQ ID NO: 576846 - DNA, 488 bp, Homo sapiens; identical to SEQ ID NO: 535990
  misc_feature: HIJSMM301C9QUE.11.28.C06.1.454.light.4.raw

SEQ ID NO: 576847 - DNA, 483 bp, Homo sapiens
  misc_feature: HIJSMM301BUSFN.48.40.D07.1.454.light.4.raw
agtatacatacacgaccggtgctcgatttagtgatagagcgtaacaacagaggggactgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggccgaaggaccgaaggtaggagacg

SEQ ID NO: 576848 - DNA, 490 bp, Homo sapiens
  misc_feature: HIJSMM301EW1HV.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccggccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccatctgt

SEQ ID NO: 576849 - DNA, 488 bp, Homo sapiens
  misc_feature: HIJSMM301BXOE8.7.85.H08.1.454.light.4.raw
  modified_base (220)..(220): a, c, t, g, unknown or other
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggancagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagaccccg

SEQ ID NO: 576850 - DNA, 484 bp, Homo sapiens; identical to SEQ ID NO: 540581
  misc_feature: HIJSMM301CJBCG.3.88.H11.1.454.light.4.raw

SEQ ID NO: 576851 - DNA, 496 bp, Homo sapiens
  misc_feature: HIJSMM301CFGD2.40.55.E11.1.454.light.4.raw
  modified_base (449)..(449): a, c, t, g, unknown or other
tctagcgactcacgaccggtgctcgatttagcactcgcacgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagattcactctcaccatcaccagcctgcaggctgaagatgtggcggtttattactgtcaacaatattactggtcaatctctatntttcgcggtagggaccgaagtagggagagtacagaacgaactagtgg

SEQ ID NO: 576852 - DNA, 486 bp, Homo sapiens; identical to SEQ ID NO: 535385
  misc_feature: HIJSMM301EWRQ8.19.71.G05.1.454.light.4.raw

SEQ ID NO: 576853 - DNA, 497 bp, Homo sapiens; identical to SEQ ID NO: 536376
  misc_feature: HIJSMM301D5I6U.22.9.A09.1.454.light.4.raw

SEQ ID NO: 576854 - DNA, 484 bp, Homo sapiens
  misc_feature: HIJSMM301DFQ4G.52.23.C01.1.454.light.4.raw
cgcagtacgacacgaccggtgctcgatttagtacacgtgattagggattgggtgacttcgcaggcgtagactttgtgtttctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagacgaactgtggctgcaccatctgtcttcatcttcccgccatctgatatacg

SEQ ID NO: 576855 - DNA, 495 bp, Homo sapiens; identical to SEQ ID NO: 535486
  misc_feature: HIJSMM301B3T5D.26.72.G06.1.454.light.4.raw

SEQ ID NO: 576856 - DNA, 504 bp, Homo sapiens
  misc_feature: HIJSMM301AWWCD.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactattaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagaatcaaacgaactgtggctgcaccatctgtcttcatcttccgccat

SEQ ID NO: 576857 - DNA, 492 bp, Homo sapiens
  misc_feature: HIJSMM301D8GIN.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctcgtacacttttggccaggggaccaagctagaaatcaaacgaactgtgctgcaccatctgtcttcta

SEQ ID NO: 576858 - DNA, 457 bp, Homo sapiens
  misc_feature: HIJSMM301C13UC.11.86.H09.1.454.light.4.raw
cgagagataccacgaccggtgctcgatttagtgctatagacttgggtttggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttccaccctcctcgtatctctcg

SEQ ID NO: 576859 - DNA, 483 bp, Homo sapiens
  misc_feature: HIJSMM301CNY7A.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagatttgcaacttattactgtcaacaggtttatatttaccctcgttattttccggcccttgggaccacagtagatatcaaacgaactgtggctgcacatt

SEQ ID NO: 576860 - DNA, 500 bp, Homo sapiens
  misc_feature: HIJSMM301C8XQZ.4.39.D06.1.454.light.4.raw
agcactgtagcacgaccggtgctcgatttagtgacatctcgcagttctttggggggggctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagccaaggctgccccctc

SEQ ID NO: 576861 - DNA, 491 bp, Homo sapiens
  misc_feature: HIJSMM301DYE8W.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggtcaggggaccaaggctggagatcaaacgaactgtgg

SEQ ID NO: 576862 - DNA, 504 bp, Homo sapiens
  misc_feature: HIJSMM301D7BU8.27.78.H01.1.454.light.4.raw
  modified_base (419)..(419): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagntgctgcaacttattactgtcatcagagtactactttacctcaagtgatcaccttcggccaagggacacgactgggagattaaacg

SEQ ID NO: 576863 - DNA, 495 bp, Homo sapiens
  misc_feature: HIJSMM301B88R2.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggcccaaccca

SEQ ID NO: 576864 - DNA, 497 bp, Homo sapiens
  misc_feature: HIJSMM301E0KT1.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgtttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgtactttattactgtcagcagcgtagcaactggcctctcactttcggcggagggaccagggtggagatcaaacgaactgtggctgcacc

SEQ ID NO: 576865 - DNA, 497 bp, Homo sapiens; identical to SEQ ID NO: 535664
  misc_feature: HIJSMM301AJZF1.22.14.B03.1.454.light.4.raw

SEQ ID NO: 576866 - DNA, 476 bp, Homo sapiens
  misc_feature: HIJSMM301D4Y91.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagcactttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagtattttgctaactttactactgtcaacagagttttcagtatcccttggactttcggccaagggaccaaggtggaaatcaaacgaa

SEQ ID NO: 576867 - DNA, 503 bp, Homo sapiens
  misc_feature: HIJSMM301DAESH.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccagggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctggggacagacttcactctcaccatcagcagcctagagcctgaagattttgcagtttatactgtcagcagcgtgccactttcggcggaggtgccacttcggcggagggaccaaatagaggtcaaacgaactagtggctgcaccatctgtcttcattcc

SEQ ID NO: 576868 - DNA, 444 bp, Homo sapiens; identical to SEQ ID NO: 535411
  misc_feature: HIJSMM301D7DJM.8.73.G07.1.454.light.4.raw

SEQ ID NO: 576869 - DNA, 494 bp, Homo sapiens; identical to SEQ ID NO: 534994
  misc_feature: HIJSMM301A07DQ.27.78.H01.1.454.light.4.raw

SEQ ID NO: 576870 - DNA, 496 bp, Homo sapiens; identical to SEQ ID NO: 537925
  misc_feature: HIJSMM301DQYP3.22.14.B03.1.454.light.4.raw

SEQ ID NO: 576871 - DNA, 505 bp, Homo sapiens; identical to SEQ ID NO: 535987
  misc_feature: HIJSMM301CKF9M.18.37.D04.1.454.light.4.raw

SEQ ID NO: 576872 - DNA, 488 bp, Homo sapiens; identical to SEQ ID NO: 545628
  misc_feature: HIJSMM301EH7IA.14.55.E11.1.454.light.4.raw

SEQ ID NO: 576873 - DNA, 485 bp, Homo sapiens; identical to SEQ ID NO: 535501
  misc_feature: HIJSMM301D40MA.3.10.A10.1.454.light.4.raw

SEQ ID NO: 576874 - DNA, 486 bp, Homo sapiens; identical to SEQ ID NO: 536323
  misc_feature: HIJSMM301BL1GT.10.2.A02.1.454.light.4.raw

SEQ ID NO: 576875 - DNA, 503 bp, Homo sapiens
  misc_feature: HIJSMM301EEPZ9.41.70.G04.1.454.light.4.raw
tctatactatcacgaccggtgctcgatttagtgtagtgtgaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtccactcttcg

SEQ ID NO: 576876 - DNA, 484 bp, Homo sapiens
  misc_feature: HIJSMM301DPX3Y.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccgaagggaccaaggtggaaatacaaacgaactagtggctgcacca

SEQ ID NO: 576877 - DNA, 492 bp, Homo sapiens; identical to SEQ ID NO: 535126
  misc_feature: HIJSMM301A1OJU.18.11.A11.1.454.light.4.raw

SEQ ID NO: 576878 - DNA, 512 bp, Homo sapiens
  misc_feature: HIJSMM301BI5DB.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttct

SEQ ID NO: 576879 - DNA, 495 bp, Homo sapiens; identical to SEQ ID NO: 537415
  misc_feature: HIJSMM301BV3M1.4.27.C05.1.454.light.4.raw

SEQ ID NO: 576880 - DNA, 488 bp, Homo sapiens; identical to SEQ ID NO: 544442
  misc_feature: HIJSMM301A5IOT.19.57.F02.1.454.light.4.raw

SEQ ID NO: 576881 - DNA, 493 bp, Homo sapiens; identical to SEQ ID NO: 539202
  misc_feature: HIJSMM301BSZNY.22.57.F02.1.454.light.4.raw

SEQ ID NO: 576882 - DNA, 506 bp, Homo sapiens
  misc_feature: HIJSMM301EZCYQ.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaaggtcaccgtcctaggtcagcccaaggccaaaccccca

SEQ ID NO: 576883 - DNA, 507 bp, Homo sapiens; identical to SEQ ID NO: 535641
  misc_feature: HIJSMM301CPQOQ.10.88.H11.1.454.light.4.raw

SEQ ID NO: 576884 - DNA, 496 bp, Homo sapiens
  misc_feature: HIJSMM301AV05O.49.20.B09.1.454.light.4.raw
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccaggtcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcactctcg

SEQ ID NO: 576885 - DNA, 491 bp, Homo sapiens
  misc_feature: HIJSMM301AEJVT.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnacctttcggcggtagggaccaaggcggagatcagacgaactgtggctgcaccatctgtcttcta

SEQ ID NO: 576886 - DNA, 506 bp, Homo sapiens; identical to SEQ ID NO: 563474
  misc_feature: HIJSMM301BA0CA.10.27.C05.1.454.light.4.raw

SEQ ID NO: 576887 - DNA, 499 bp, Homo sapiens
  misc_feature: HIJSMM301EAEB3.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggaccaagctgaccgtcctgcgtcagcccaaggctgccccctggtcact

SEQ ID NO: 576888 - DNA, 516 bp, Homo sapiens
  misc_feature: HIJSMM301B16JJ.43.59.F04.1.454.light.4.raw
tgtgagtagtcacgaccggtgctcgatttagtacacacacttagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccctcctca

SEQ ID NO: 576889 - DNA, 502 bp, Homo sapiens
  misc_feature: HIJSMM301C0OBG.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaaccccactgtca

SEQ ID NO: 576890 - DNA, 489 bp, Homo sapiens; identical to SEQ ID NO: 535139
  misc_feature: HIJSMM301DKI6Y.14.55.E11.1.454.light.4.raw

SEQ ID NO: 576891 - DNA, 501 bp, Homo sapiens
  misc_feature: HIJSMM301EU32K.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctcctgacaatctctgggctccaggctgacgacgaggctaattattactgctgctcatatgaaggttataacactatactattcggcggagggaccaagctgaccgtcctgcgtcagcccaaggctcgccccctcggtcact

SEQ ID NO: 576892 - DNA, 488 bp, Homo sapiens
  misc_feature: HIJSMM301CK43T.52.55.E11.1.454.light.4.raw
cgcagtacgacacgaccggtgctcgatttagcactcgcacgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacggtgggacactggcattttgggtgttcgggcggagggaccaagttgaccgtcctaggtcagcccaaggctcg

SEQ ID NO: 576893 - DNA, 500 bp, Homo sapiens
  misc_feature: HIJSMM301ENSV7.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaaccca

SEQ ID NO: 576894 - DNA, 495 bp, Homo sapiens
  misc_feature: HIJSMM301AN5EI.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaacggcggagatcagacgaactagtggcgtgcaccactctcgtcttcta

SEQ ID NO: 576895 - DNA, 489 bp, Homo sapiens
  misc_feature: HIJSMM301CFCZ8.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcgggtttactactgcatgcagggtacactctggccgttcacttttggccaggggaccaaactggatatcagacgaactgtggctgca

SEQ ID NO: 576896 - DNA, 480 bp, Homo sapiens; identical to SEQ ID NO: 535442
  misc_feature: HIJSMM301ECWKO.41.17.B06.1.454.light.4.raw

SEQ ID NO: 576897 - DNA, 494 bp, Homo sapiens; identical to SEQ ID NO: 534994
  misc_feature: HIJSMM301BL4EV.27.78.H01.1.454.light.4.raw

SEQ ID NO: 576898 - DNA, 492 bp, Homo sapiens; identical to SEQ ID NO: 541945
  misc_feature: HIJSMM301DURBI.49.67.G01.1.454.light.4.raw

SEQ ID NO: 576899 - DNA, 493 bp, Homo sapiens; identical to SEQ ID NO: 537239
  misc_feature: HIJSMM301DJ88R.49.66.F11.1.454.light.4.raw

SEQ ID NO: 576900 - DNA, 491 bp, Homo sapiens
  misc_feature: HIJSMM301C6V1E.51.46.E02.1.454.light.4.raw
cgatcgtatacacgaccggtgctcgatttagactcatctacagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccgccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacttcggccaagggaccaaggtggaaatgaaaggaactgtggctgcaccatctgt

SEQ ID NO: 576901 - DNA, 487 bp, Homo sapiens
  misc_feature: HIJSMM301BXXTL.52.34.D01.1.454.light.4.raw
cgcagtacgacacgaccggtgctcgatttagatcgtctgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcagtttgggtgttcggcggagggaccaagttgaccgtcctaggtcagcccaaggctccg

SEQ ID NO: 576902 - DNA, 489 bp, Homo sapiens; identical to SEQ ID NO: 549642
  misc_feature: HIJSMM301ECBF1.52.70.G04.1.454.light.4.raw

SEQ ID NO: 576903 - DNA, 444 bp, Homo sapiens; identical to SEQ ID NO: 535411
  misc_feature: HIJSMM301AFBOP.8.73.G07.1.454.light.4.raw

SEQ ID NO: 576904 - DNA, 488 bp, Homo sapiens
  misc_feature: HIJSMM301DGKIE.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctggaggatgttgggctctattattgcatgcaagctctacaagtcccgctcactttcggcggagggaccaaggtggagatcaaacgtaacg

SEQ ID NO: 576905 - DNA, 505 bp, Homo sapiens
  misc_feature: HIJSMM301EWCGS.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccaagggaccaaggtggaaatacaaacgaactgtggctgcaccat

SEQ ID NO: 576906 - DNA, 510 bp, Homo sapiens
  misc_feature: HIJSMM301EI1QV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtacaaacgaactagtggctgtcaccaatctgtcttctatcttccccg

SEQ ID NO: 576907 - DNA, 489 bp, Homo sapiens; identical to SEQ ID NO: 535139
  misc_feature: HIJSMM301A2ZUN.14.55.E11.1.454.light.4.raw

SEQ ID NO: 576908 - DNA, 487 bp, Homo sapiens; identical to SEQ ID NO: 541187
  misc_feature: HIJSMM301AYUWQ.43.36.D03.1.454.light.4.raw

SEQ ID NO: 576909 - DNA, 487 bp, Homo sapiens; identical to SEQ ID NO: 535299
  misc_feature: HIJSMM301EMR7V.21.55.E11.1.454.light.4.raw

SEQ ID NO: 576910 - DNA, 493 bp, Homo sapiens; identical to SEQ ID NO: 538136
  misc_feature: HIJSMM301CDWLQ.47.64.F09.1.454.light.4.raw

SEQ ID NO: 576911 - DNA, 485 bp, Homo sapiens; identical to SEQ ID NO: 535688
  misc_feature: HIJSMM301BIIQJ.19.5.A05.1.454.light.4.raw

SEQ ID NO: 576912 - DNA, 528 bp, Homo sapiens
  misc_feature: HIJSMM301AS2E9.9.38.D05.1.454.light.4.raw
tgatacgtctcacgaccggtgctcgatttagtatctgatagttggggtttgggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggtcgggggaccgaaggtgaccgtcctaagtcagccaacggctgccccctcggtcactctcgttcccaccctcctcacg

SEQ ID NO: 576913 - DNA, 497 bp, Homo sapiens; identical to SEQ ID NO: 534982
  misc_feature: HIJSMM301AD2LN.26.80.H03.1.454.light.4.raw

SEQ ID NO: 576914 - DNA, 494 bp, Homo sapiens
  misc_feature: HIJSMM301EGEGV.3.78.H01.1.454.light.4.raw
agacgcactccacgaccggtgctcgatttagtgtgagtagtttgggtttgggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttc

SEQ ID NO: 576915 - DNA, 494 bp, Homo sapiens; identical to SEQ ID NO: 536477
  misc_feature: HIJSMM301B36UP.22.5.A05.1.454.light.4.raw

SEQ ID NO: 576916 - DNA, 496 bp, Homo sapiens
  misc_feature: HIJSMM301ALBOR.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtatgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 576917 - DNA, 484 bp, Homo sapiens; identical to SEQ ID NO: 535240
  misc_feature: HIJSMM301C9MFU.47.60.F05.1.454.light.4.raw

SEQ ID NO: 576918 - DNA, 481 bp, Homo sapiens
  misc_feature: HIJSMM301C36BY.3.50.E06.1.454.light.4.raw
agacgcactccacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaattggtatcagcaaaaaccagggaaagcccctaaacttttgatctatgctgcatccagtttgcaaagtggggtcccatcaaggttcaatggcagtggatctgggacagatttcactctcaccatcagcagtctacagcctgaagattttgcaacttactactgtcaacagagttacagtacttggtatttcactttcggcctggaccaaagtggacatcaaacgaactgtgg

SEQ ID NO: 576919 - DNA, 464 bp, Homo sapiens; identical to SEQ ID NO: 537111
  misc_feature: HIJSMM301BFIHP.17.28.C06.1.454.light.4.raw

SEQ ID NO: 576920 - DNA, 497 bp, Homo sapiens; identical to SEQ ID NO: 535664
  misc_feature: HIJSMM301DIKNB.22.14.B03.1.454.light.4.raw

SEQ ID NO: 576921 - DNA, 509 bp, Homo sapiens; identical to SEQ ID NO: 535670
  misc_feature: HIJSMM301A6I96.47.23.C01.1.454.light.4.raw

SEQ ID NO: 576922 - DNA, 495 bp, Homo sapiens
  misc_feature: HIJSMM301BJIQ4.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatataacaatcagcaacacttatgtcttcgggactgggaccaagatcaccgtctaggtcagccaagccaacccatg

SEQ ID NO: 576923 - DNA, 504 bp, Homo sapiens
  misc_feature: HIJSMM301EVAMW.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactagtggctgcaccatctgtcttcatcttccgcc

SEQ ID NO: 576924 - DNA, 514 bp, Homo sapiens
  misc_feature: HIJSMM301A7AJD.40.33.C11.1.454.light.4.raw
tctagcgactcacgaccggtgctcgatttagagtgagctcgttgggtttggggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccgacttgggtgttcggcggagggaccaagctgaccgtcccg

SEQ ID NO: 576925 - DNA, 465 bp, Homo sapiens; identical to SEQ ID NO: 542124
  misc_feature: HIJSMM301E0568.48.59.F04.1.454.light.4.raw

SEQ ID NO: 576926 - DNA, 497 bp, Homo sapiens; identical to SEQ ID NO: 545672
  misc_feature: HIJSMM301AWIQ4.2.49.E05.1.454.light.4.raw

SEQ ID NO: 576927 - DNA, 475 bp, Homo sapiens; identical to SEQ ID NO: 542145
  misc_feature: HIJSMM301AJ9KE.40.59.F04.1.454.light.4.raw

SEQ ID NO: 576928 - DNA, 463 bp, Homo sapiens
  misc_feature: HIJSMM301DXUJN.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattaactgtcaacagtatgatagtctcccgctcactttcggcggggggaccaaggtggagatcaagcgaa

SEQ ID NO: 576929 - DNA, 490 bp, Homo sapiens
  misc_feature: HIJSMM301CT1RI.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggtattttgctaacttattactgccagcagtataatgattaccctatcaccttcgggccggggacacggctaggaaactaaacgaactgtggctgcaccta

SEQ ID NO: 576930 - DNA, 486 bp, Homo sapiens; identical to SEQ ID NO: 535385
  misc_feature: HIJSMM301B7XWN.19.71.G05.1.454.light.4.raw

SEQ ID NO: 576931 - DNA, 492 bp, Homo sapiens
  misc_feature: HIJSMM301CFSLS.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctggtactttggccaggggaccaagctggagatcaaacgaactgtggctgcacatctgtctt

SEQ ID NO: 576932 - DNA, 484 bp, Homo sapiens
  misc_feature: HIJSMM301A9Z32.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcat

SEQ ID NO: 576933 - DNA, 520 bp, Homo sapiens
  misc_feature: HIJSMM301BP6OP.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgtagcctgaggacgaggctgactattactgcctactctactttggtggtgctgtgctattcggcggagggaccaagctgaccgtcttaagtcagcccaaggctgccccctcggtcactctgttcccgccctcctcctacg

SEQ ID NO: 576934 - DNA, 506 bp, Homo sapiens; identical to SEQ ID NO: 551204
  misc_feature: HIJSMM301DK3GS.15.59.F04.1.454.light.4.raw

SEQ ID NO: 576935 - DNA, 511 bp, Homo sapiens
  misc_feature: HIJSMM301DCDN3.2.35.D02.1.454.light.4.raw
acgctcgacacacgaccggtgctcgatttagcacacgatagttgggtttgggggtctcaggaggcagcgctctcaggacgtcaccaccatggcctgggctctgctccccctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgttacttttcggcggagggaccaagctgaccgtcctgggtcagcccaaggctcgccccctcggtcacttccg

SEQ ID NO: 576936 - DNA, 485 bp, Homo sapiens; identical to SEQ ID NO: 535985
  misc_feature: HIJSMM301E22DF.15.1.A01.1.454.light.4.raw

SEQ ID NO: 576937 - DNA, 485 bp, Homo sapiens
  misc_feature: HIJSMM301BHMKZ.5.34.D01.1.454.light.4.raw
atcagacacgcacgaccggtgctcgatttagatcgtctgtgttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaaggacgacgactggagataaacgaactagtggctgcaccta

SEQ ID NO: 576938 - DNA, 515 bp, Homo sapiens
  misc_feature: HIJSMM301ER1ME.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcaggtcagcccaaggctgccccctggtcactctgttcccgccctcctcacg

SEQ ID NO: 576939 - DNA, 525 bp, Homo sapiens
  misc_feature: HIJSMM301CUL3P.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaaggtacgaaacgaaacgtacgtggcgtgcaccactctgtcttctactcttcccgccctact

SEQ ID NO: 576940 - DNA, 513 bp, Homo sapiens
  misc_feature: HIJSMM301BR1OA.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctggtcactctgttccccg

SEQ ID NO: 576941 - DNA, 487 bp, Homo sapiens
  misc_feature: HIJSMM301EP50R.43.4.A04.1.454.light.4.raw
tgtgagtagtcacgaccggtgctcgatttagagtagtgatcaggggaagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcggccaagggaccaaggtggaattcaaccgaactgtggctgcaccat

SEQ ID NO: 576942 - DNA, 497 bp, Homo sapiens; identical to SEQ ID NO: 545672
  misc_feature: HIJSMM301DWXMA.2.49.E05.1.454.light.4.raw

SEQ ID NO: 576943 - DNA, 493 bp, Homo sapiens
  misc_feature: HIJSMM301AP4J0.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccaagcaccca

SEQ ID NO: 576944 - DNA, 507 bp, Homo sapiens; identical to SEQ ID NO: 535930
  misc_feature: HIJSMM301A2UJV.15.34.D01.1.454.light.4.raw

SEQ ID NO: 576945 - DNA, 486 bp, Homo sapiens; identical to SEQ ID NO: 535043
  misc_feature: HIJSMM301A1Q2O.46.35.D02.1.454.light.4.raw

SEQ ID NO: 576946 - DNA, 480 bp, Homo sapiens
  misc_feature: HIJSMM301CSY7C.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtactgggacagagttcactctcaccatcagcagcctgcagtctgaagattttgcaatttattactgtcagcagtataataaactggcctcgtacactttgtcagggacgaacgactgagatcaaacgaacagtgcgtgcacca

SEQ ID NO: 576947 - DNA, 488 bp, Homo sapiens; identical to SEQ ID NO: 538628
  misc_feature: HIJSMM301COY5U.40.8.A08.1.454.light.4.raw

SEQ ID NO: 576948 - DNA, 517 bp, Homo sapiens
  misc_feature: HIJSMM301BE9PX.10.28.C06.1.454.light.4.raw
catagtagtgcacgaccggtgctcgatttagagctcacgtattgggtttggggggggtcgtcaggaggcggccctctcgggacgtctccaccatggcctcgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcggggggaccgacactgaccgtcctaggtcagcccaaggctgccccctcggtcactctgtt

SEQ ID NO: 576949 - DNA, 480 bp, Homo sapiens; identical to SEQ ID NO: 535630
  misc_feature: HIJSMM301C3PJV.40.59.F04.1.454.light.4.raw

SEQ ID NO: 576950 - DNA, 485 bp, Homo sapiens
  misc_feature: HIJSMM301C03PX.40.81.H04.1.454.light.4.raw
tctagcgactcacgaccggtgctcgatttagtagtgtagattcgcgggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtgg

SEQ ID NO: 576951 - DNA, 495 bp, Homo sapiens; identical to SEQ ID NO: 535821
  misc_feature: HIJSMM301CRFBY.3.31.C09.1.454.light.4.raw

SEQ ID NO: 576952 - DNA, 517 bp, Homo sapiens; identical to SEQ ID NO: 571330
  misc_feature: HIJSMM301DIZWA.41.25.C03.1.454.light.4.raw

SEQ ID NO: 576953 - DNA, 494 bp, Homo sapiens
  misc_feature: HIJSMM301CB1Z0.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcggtttattactgtcagcagtataataactggcctccacggtacacttttggccaggggaccaagctggagatcaaacgaactagtggctgcaccatct

SEQ ID NO: 576954 - DNA, 489 bp, Homo sapiens
  misc_feature: HIJSMM301EXIAI.43.20.B09.1.454.light.4.raw
  modified_base (182)..(182): a, c, t, g, unknown or other
tgtgagtagtcacgaccggtgctcgatttagtgtagtgtgaagggggaagagctgctcagttaggacccagagggaaccatggaaaccccagcgcagcttctcttcctcctgctactctggctcccagataccaccggagaaattgtgttgacgcagtctccgggcaccctgtctttgtctncaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcaccagtatggtagctcacctaagacgttcggccaagggaccaaggtggaaatcaaacgaactgtggctgcaccatctgtctt

SEQ ID NO: 576955 - DNA, 498 bp, Homo sapiens; identical to SEQ ID NO: 538742
  misc_feature: HIJSMM301DYSM8.43.25.C03.1.454.light.4.raw

SEQ ID NO: 576956 - DNA, 495 bp, Homo sapiens
  misc_feature: HIJSMM301EFUHT.41.35.D02.1.454.light.4.raw
tctatactatcacgaccggtgctcgatttagcacacgatagttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaagg

SEQ ID NO: 576957 - DNA, 499 bp, Homo sapiens
  misc_feature: HIJSMM301CUDUC.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctataggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactcttcg

SEQ ID NO: 576958 - DNA, 482 bp, Homo sapiens
  misc_feature: HIJSMM301AWPZA.11.17.B06.1.454.light.4.raw
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccgaaggtggaaatcaaacgaactagtggctgcaccta

SEQ ID NO: 576959 - DNA, 497 bp, Homo sapiens
  misc_feature: HIJSMM301CRF32.18.22.B11.1.454.light.4.raw
tacgagtatgcacgaccggtgctcgatttagacgacagctcaggggcagcaagatggtgttgcagacccaggtcttcatttctctgttgctctggatctctggtacctacggggacttcgtgatgacccagtctccagactccctggctgtgtctctgggcgagagggccaccatcaactgcaagtccagccagagtattttaaagaactccaacaatcagaattacttaacttggtatcagcagaaagcaggccagcctcccaagttgctcatttactgggcatcaacccgggaatccggggtccctgaccgattcagtggcagcgggtctgggacagacttcactctcaccatcagcagcctgcaggctgaagatgtggcagtttattactgtcagcagtattatagtactcctccgacgttcggccaagggaccaaggtggagattaaacgaactgtggctgcaccatctgtcttcatcttcccgccatctgaa

SEQ ID NO: 576960 - DNA, 481 bp, Homo sapiens; identical to SEQ ID NO: 537385
  misc_feature: HIJSMM301BAR1U.52.4.A04.1.454.light.4.raw

SEQ ID NO: 576961 - DNA, 503 bp, Homo sapiens; identical to SEQ ID NO: 541454
  misc_feature: HIJSMM301DWIQN.9.12.B01.1.454.light.4.raw

SEQ ID NO: 576962 - DNA, 504 bp, Homo sapiens
  misc_feature: HIJSMM301A3ADF.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctc

SEQ ID NO: 576963 - DNA, 484 bp, Homo sapiens; identical to SEQ ID NO: 535400
  misc_feature: HIJSMM301ELS82.46.26.C04.1.454.light.4.raw

SEQ ID NO: 576964 - DNA, 504 bp, Homo sapiens; identical to SEQ ID NO: 555616
  misc_feature: HIJSMM301BHQ47.5.86.H09.1.454.light.4.raw

SEQ ID NO: 576965 - DNA, 486 bp, Homo sapiens; identical to SEQ ID NO: 535043
  misc_feature: HIJSMM301BABXK.46.35.D02.1.454.light.4.raw

SEQ ID NO: 576966 - DNA, 494 bp, Homo sapiens; identical to SEQ ID NO: 534992
  misc_feature: HIJSMM301BY5TR.9.1.A01.1.454.light.4.raw

SEQ ID NO: 576967 - DNA, 489 bp, Homo sapiens
  misc_feature: HIJSMM301CQI93.41.31.C09.1.454.light.4.raw
tctatactatcacgaccggtgctcgatttagacgtctcatcaaggaaggaagggcacgaccggtgctcgatttagtgtgagtagtttgggtttggggtgatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcggtccgggacagatttcacactgaggatcagtcgggtggaggctgacgacgttgggacttattactgcgcgcaaagtctacaccttcctct

SEQ ID NO: 576968 - DNA, 497 bp, Homo sapiens
  misc_feature: HIJSMM301CUWT7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaagggaccgaaggtaggatatcagacgaactagtggctg

SEQ ID NO: 576969 - DNA, 509 bp, Homo sapiens
  misc_feature: HIJSMM301CJ4ZS.12.53.E09.1.454.light.4.raw
atacgacgtacacgaccggtgctcgatttagagagagtgtgttgggtttgggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagccaaggctgccccctc

SEQ ID NO: 576970 - DNA, 510 bp, Homo sapiens
  misc_feature: HIJSMM301DERBH.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtccccagccaggttcgatggcagtgggtctggggacagacttcactctcaccatcagcagcctggagcctgaagatattgctagtttattattgtcagcagcgtagcaggtggcctttcactttcggcccgggtaccaagtaggaaatacaaacgaactgtggctgcaccatctgtcttcatcttccgcc

SEQ ID NO: 576971 - DNA, 530 bp, Homo sapiens
  misc_feature: HIJSMM301EUOH1.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacgagcgaggtcggttccttaggtcgggttggttccgggggccgggggaaccgaacggcgtcggacccgtccgtaggtccacgacccgaaggcgtccgcccccgtcggtccacctctcgtt

SEQ ID NO: 576972 - DNA, 489 bp, Homo sapiens; identical to SEQ ID NO: 535638
  misc_feature: HIJSMM301CHGZ7.3.55.E11.1.454.light.4.raw

SEQ ID NO: 576973 - DNA, 500 bp, Homo sapiens; identical to SEQ ID NO: 540219
  misc_feature: HIJSMM301AO0OV.43.34.D01.1.454.light.4.raw

SEQ ID NO: 576974 - DNA, 496 bp, Homo sapiens; identical to SEQ ID NO: 550698
  misc_feature: HIJSMM301AUFVZ.13.76.G10.1.454.light.4.raw

SEQ ID NO: 576975 - DNA, 496 bp, Homo sapiens
  misc_feature: HIJSMM301BBFZA.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactgtggctgcaccatctgtcttcta

SEQ ID NO: 576976 - DNA, 520 bp, Homo sapiens
  misc_feature: HIJSMM301DECI4.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggacactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcattctgttcccaccct

SEQ ID NO: 576977 - DNA, 489 bp, Homo sapiens; identical to SEQ ID NO: 542780
  misc_feature: HIJSMM301EEWK3.16.53.E09.1.454.light.4.raw

SEQ ID NO: 576978 - DNA, 494 bp, Homo sapiens; identical to SEQ ID NO: 534994
  misc_feature: HIJSMM301DIW43.27.78.H01.1.454.light.4.raw

SEQ ID NO: 576979 - DNA, 513 bp, Homo sapiens
  misc_feature: HIJSMM301ESSQJ.8.88.H11.1.454.light.4.raw
ctcgcgtgtccacgaccggtgctcgatttagcgacagcgagaacacacaaaggggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccgtggacgttcggccaagggaccaaggtggcaatcaaccgaactgtggctgcaccatctgtcttcatccttcccgcc

SEQ ID NO: 576980 - DNA, 502 bp, Homo sapiens
  misc_feature: HIJSMM301EQGWK.19.10.A10.1.454.light.4.raw
tactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagatttgcagtgtattactgtcaacgatatgatgagtcacctccgtggtggacatttggccaggggaccaaggttgaagtcaaacgaactgtggctgcaccatctgtcttcatcttccccg

SEQ ID NO: 576981 - DNA, 496 bp, Homo sapiens
  misc_feature: HIJSMM301AHG7H.49.41.D08.1.454.light.4.raw
agtcgagagacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttagctcattttcggcggaggggaccaaggtggagatcaaacgaactgtggctgcaccatctgtcttcta

SEQ ID NO: 576982 - DNA, 478 bp, Homo sapiens; identical to SEQ ID NO: 535129
  misc_feature: HIJSMM301E0XF2.11.11.A11.1.454.light.4.raw

SEQ ID NO: 576983 - DNA, 483 bp, Homo sapiens
  misc_feature: HIJSMM301B5PXO.48.19.B08.1.454.light.4.raw
agtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcattatgcaggcagctacacttgggtgttcggcggagggaccaagctgaccgtcctaggtcagcccaa

SEQ ID NO: 576984 - DNA, 497 bp, Homo sapiens; identical to SEQ ID NO: 535740
  misc_feature: HIJSMM301AL7FF.3.71.G05.1.454.light.4.raw

SEQ ID NO: 576985 - DNA, 509 bp, Homo sapiens
  misc_feature: HIJSMM301DHK8G.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaatacaaacgaactagtggctgcaccatctgtctt

SEQ ID NO: 576986 - DNA, 507 bp, Homo sapiens; identical to SEQ ID NO: 565303
  misc_feature: HIJSMM301AE9EL.19.78.H01.1.454.light.4.raw

SEQ ID NO: 576987 - DNA, 496 bp, Homo sapiens; identical to SEQ ID NO: 547168
  misc_feature: HIJSMM301EGIRP.8.10.A10.1.454.light.4.raw

SEQ ID NO: 576988 - DNA, 492 bp, Homo sapiens
  misc_feature: HIJSMM301EDI2X.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgcccctcggtcactctgtcccgccctcctcgctacgtaga

SEQ ID NO: 576989 - DNA, 499 bp, Homo sapiens
  misc_feature: HIJSMM301DA589.48.82.H05.1.454.light.4.raw
agtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctgccccctc

SEQ ID NO: 576990 - DNA, 511 bp, Homo sapiens
  misc_feature: HIJSMM301BZYXX.16.46.E02.1.454.light.4.raw
tgtactactccacgaccggtgctcgatttagactcatctacaggggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtctaggtcagcccaaggcccaacccactgtcactctcg

SEQ ID NO: 576991 - DNA, 509 bp, Homo sapiens
  misc_feature: HIJSMM301CTS2V.17.33.C11.1.454.light.4.raw
  modified_base (503)..(503): a, c, t, g, unknown or other
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctnttcccg

SEQ ID NO: 576992 - DNA, 494 bp, Homo sapiens; identical to SEQ ID NO: 546793
  misc_feature: HIJSMM301EN7UH.27.78.H01.1.454.light.4.raw

SEQ ID NO: 576993 - DNA, 498 bp, Homo sapiens
  misc_feature: HIJSMM301BABPW.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgttcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggccaaaggtggatatcagacgaactgtggctgcaa

SEQ ID NO: 576994 - DNA, 493 bp, Homo sapiens
  misc_feature: HIJSMM301B67OL.41.2.A02.1.454.light.4.raw
tctatactatcacgaccggtgctcgatttagactcatctacagggggtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagttcggtcggagggaccaaggttgagatcaaacgaactgtggctgcaccatctgtcttcatcttccccg

SEQ ID NO: 576995 - DNA, 512 bp, Homo sapiens
  misc_feature: HIJSMM301C1RTI.48.30.C08.1.454.light.4.raw
  modified_base (431)..(431): a, c, t, g, unknown or other
agtatacatacacgaccggtgctcgatttagtctgacgtcaaagggaaagggcacgaccggtgctcgatttagtctgacgtcaaagggaaaggggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagntgctgccaacctattactgtcatcagtacttttagttacgtcggaccttcggccaagggacacgactggagattaaacgaa

SEQ ID NO: 576996 - DNA, 484 bp, Homo sapiens; identical to SEQ ID NO: 535400
  misc_feature: HIJSMM301EGK2Y.46.26.C04.1.454.light.4.raw

SEQ ID NO: 576997 - DNA, 503 bp, Homo sapiens; identical to SEQ ID NO: 537189
  misc_feature: HIJSMM301EOFRX.19.85.H08.1.454.light.4.raw

SEQ ID NO: 576998 - DNA, 485 bp, Homo sapiens; identical to SEQ ID NO: 535501
  misc_feature: HIJSMM301A5B25.3.10.A10.1.454.light.4.raw

SEQ ID NO: 576999 - DNA, 504 bp, Homo sapiens
  misc_feature: HIJSMM301EL9K3.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagccaaggctgccccctcggtcactctgttcccaccctcctctacgtcgtat

SEQ ID NO: 577000 - DNA, 489 bp, Homo sapiens; identical to SEQ ID NO: 536663
  misc_feature: HIJSMM301EW1AB.16.72.G06.1.454.light.4.raw

SEQ ID NO: 577001 - DNA, 506 bp, Homo sapiens; identical to SEQ ID NO: 542696
  misc_feature: HIJSMM301CH8L7.7.71.G05.1.454.light.4.raw

SEQ ID NO: 577002 - DNA, 494 bp, Homo sapiens
  misc_feature: HIJSMM301CHQ37.40.71.G05.1.454.light.4.raw
tctagcgactcacgaccggtgctcgatttagtgtcgtcgcaagagagagggggagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtcct

SEQ ID NO: 577003 - DNA, 490 bp, Homo sapiens
  misc_feature: HIJSMM301AYW6O.40.56.F01.1.454.light.4.raw
tctagcgactcacgaccggtgctcgatttagcagacgtctgaacacacaaaggggggagtcagacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggatttatacctggttggcctggtatcagcagaaaccagggaaagcccctgacctcctgatctttaaggcgtctactttggagacatgggtcccatcaaggttcagcggcagtggatccgagacagaattcactctcaccatcagcagcctgcagccggatgattttgcaacttattactgccaacactatgatagttattctccgtacacctttggccaggggaccaaggtggagatcaagcgaactgtggctgcaccat

SEQ ID NO: 577004 - DNA, 498 bp, Homo sapiens
  misc_feature: HIJSMM301D57XE.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtccaagggaccagggtggaaatacaaacgaaactagtggctgcaccatctgtcttcat

SEQ ID NO: 577005 - DNA, 510 bp, Homo sapiens
  misc_feature: HIJSMM301DRF67.40.81.H04.1.454.light.4.raw
tctagcgactcacgaccggtgctcgatttagtagtgtagattcgcggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctcaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctcgccccctcggtcactctgtt

SEQ ID NO: 577006 - DNA, 516 bp, Homo sapiens
  misc_feature: HIJSMM301C2Z0E.43.37.D04.1.454.light.4.raw
tgtgagtagtcacgaccggtgctcgatttagtagcatactgttgggtttgggggggaagctcagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctccggccccaggtctggcacctcagcctccctggccttcagtgggctccggccggacgatgaggttgattattactgtgcaccatgtgatgacagcctgagtggttgggtggttcggcggggggaccgaagctgaccgtcctaggtcagcccaaggctccg

SEQ ID NO: 577007 - DNA, 506 bp, Homo sapiens
  misc_feature: HIJSMM301B4EFW.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccaggtctaggccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtca

SEQ ID NO: 577008 - DNA, 491 bp, Homo sapiens
  misc_feature: HIJSMM301AVP7Y.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttgcactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgt

SEQ ID NO: 577009 - DNA, 492 bp, Homo sapiens
  misc_feature: HIJSMM301BRR2B.49.67.G01.1.454.light.4.raw
  modified_base (488)..(488): a, c, t, g, unknown or other
agtcgagagacacgaccggtgctcgatttagagtatacatattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcnccat

SEQ ID NO: 577010 - DNA, 491 bp, Homo sapiens
  misc_feature: HIJSMM301DROTQ.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaaacctgaagattttgcaacttactactgtcaacagtagtttcacctacccctctcctacgtttcggcgggggaccaaggtggagatacaaacgaactggtggctgcaccta

SEQ ID NO: 577011 - DNA, 496 bp, Homo sapiens
  misc_feature: HIJSMM301BM719.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcaggggtcttcggcggagggacgaagctgaccgtcctgagtcagcccaaggctgccccctcggtcactctgtt

SEQ ID NO: 577012 - DNA, 509 bp, Homo sapiens; identical to SEQ ID NO: 536047
  misc_feature: HIJSMM301EN8EE.17.33.C11.1.454.light.4.raw

SEQ ID NO: 577013 - DNA, 460 bp, Homo sapiens; identical to SEQ ID NO: 536053
  misc_feature: HIJSMM301BQQ5T.22.28.C06.1.454.light.4.raw

SEQ ID NO: 577014 - DNA, 485 bp, Homo sapiens; identical to SEQ ID NO: 562821
  misc_feature: HIJSMM301C0D6O.17.34.D01.1.454.light.4.raw

SEQ ID NO: 577015 - DNA, 503 bp, Homo sapiens
  misc_feature: HIJSMM301BC6NR.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactgggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 577016 - DNA, 494 bp, Homo sapiens
  misc_feature: HIJSMM301EYRFK.13.6.A06.1.454.light.4.raw
tcacgtactacacgaccggtgctcgatttagatctactgacaggggaggactcctcagttcaccttctcacaatgaggctccctgctcagctcctgggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtgaggctgaggatgttgggtttattactgcatgcaagctctacaacctctgcggactttcggccctgggaccaaacgtaggagagtcaaacgaactgtggctgcaccatctgtctt

SEQ ID NO: 577017 - DNA, 476 bp, Homo sapiens
  misc_feature: HIJSMM301DK1G6.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaaactaacgaactgtgg

SEQ ID NO: 577018 - DNA, 493 bp, Homo sapiens; identical to SEQ ID NO: 542616
  misc_feature: HIJSMM301DAAE0.4.27.C05.1.454.light.4.raw

SEQ ID NO: 577019 - DNA, 485 bp, Homo sapiens
  misc_feature: HIJSMM301A8WAO.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagcccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 577020 - DNA, 456 bp, Homo sapiens
  misc_feature: HIJSMM301CD24Z.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcgggtccttaagggtccctaggaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctcggtcactctgttcccgccctcctccacgagagta

SEQ ID NO: 577021 - DNA, 495 bp, Homo sapiens; identical to SEQ ID NO: 538277
  misc_feature: HIJSMM301CMOZB.16.53.E09.1.454.light.4.raw

SEQ ID NO: 577022 - DNA, 487 bp, Homo sapiens; identical to SEQ ID NO: 576526
  misc_feature: HIJSMM301CH08A.41.10.A10.1.454.light.4.raw

SEQ ID NO: 577023 - DNA, 494 bp, Homo sapiens; identical to SEQ ID NO: 539894
  misc_feature: HIJSMM301CFKW0.16.53.E09.1.454.light.4.raw

SEQ ID NO: 577024 - DNA, 491 bp, Homo sapiens; identical to SEQ ID NO: 535194
  misc_feature: HIJSMM301DYT6Z.26.78.H01.1.454.light.4.raw

SEQ ID NO: 577025 - DNA, 502 bp, Homo sapiens; identical to SEQ ID NO: 539314
  misc_feature: HIJSMM301CECTG.21.81.H04.1.454.light.4.raw

SEQ ID NO: 577026 - DNA, 491 bp, Homo sapiens; identical to SEQ ID NO: 535294
  misc_feature: HIJSMM301DS55V.16.68.G02.1.454.light.4.raw

SEQ ID NO: 577027 - DNA, 485 bp, Homo sapiens; identical to SEQ ID NO: 536263
  misc_feature: HIJSMM301EHFPH.47.78.H01.1.454.light.4.raw

SEQ ID NO: 577028 - DNA, 498 bp, Homo sapiens
  misc_feature: HIJSMM301BXJYC.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagccaaggctgccccctcggtcactctgttcccg

SEQ ID NO: 577029 - DNA, 497 bp, Homo sapiens; identical to SEQ ID NO: 560526
  misc_feature: HIJSMM301AM3TV.40.65.F10.1.454.light.4.raw

SEQ ID NO: 577030 - DNA, 507 bp, Homo sapiens; identical to SEQ ID NO: 535641
  misc_feature: HIJSMM301B22ZR.10.88.H11.1.454.light.4.raw

SEQ ID NO: 577031 - DNA, 473 bp, Homo sapiens; identical to SEQ ID NO: 535262
  misc_feature: HIJSMM301BL7M2.8.67.G01.1.454.light.4.raw

SEQ ID NO: 577032 - DNA, 503 bp, Homo sapiens
  misc_feature: HIJSMM301CQDVH.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctggtca

SEQ ID NO: 577033 - DNA, 498 bp, Homo sapiens
  misc_feature: HIJSMM301BOLU6.18.11.A11.1.454.light.4.raw
tacgagtatgcacgaccggtgctcgatttagctacgactgcaggggcagcaagatggtgttgcagacccaggtcttcatttctctgttgctctggactctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatctgac

SEQ ID NO: 577034 - DNA, 499 bp, Homo sapiens
  misc_feature: HIJSMM301D6Z2X.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactggcacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcact

SEQ ID NO: 577035 - DNA, 486 bp, Homo sapiens; identical to SEQ ID NO: 537617
  misc_feature: HIJSMM301DRFC0.10.53.E09.1.454.light.4.raw

SEQ ID NO: 577036 - DNA, 521 bp, Homo sapiens
  misc_feature: HIJSMM301EUZ55.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaacggtaggaaggtacgaaacgaaactacgtggcgtgcaccatctgtcttctatcttcccgtcccact

SEQ ID NO: 577037 - DNA, 489 bp, Homo sapiens; identical to SEQ ID NO: 535139
  misc_feature: HIJSMM301CDP7D.14.55.E11.1.454.light.4.raw

SEQ ID NO: 577038 - DNA, 486 bp, Homo sapiens
  misc_feature: HIJSMM301ANLFI.48.19.B08.1.454.light.4.raw
agtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctggaccgtcctaggtcaggccccaa

SEQ ID NO: 577039 - DNA, 519 bp, Homo sapiens
  misc_feature: HIJSMM301APR56.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgacggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactcgtcactctccg

SEQ ID NO: 577040 - DNA, 486 bp, Homo sapiens; identical to SEQ ID NO: 535043
  misc_feature: HIJSMM301DBS19.46.35.D02.1.454.light.4.raw

SEQ ID NO: 577041 - DNA, 494 bp, Homo sapiens; identical to SEQ ID NO: 534994
  misc_feature: HIJSMM301EGOUE.27.78.H01.1.454.light.4.raw

SEQ ID NO: 577042 - DNA, 434 bp, Homo sapiens; identical to SEQ ID NO: 560697
  misc_feature: HIJSMM301DYTL0.41.8.A08.1.454.light.4.raw

SEQ ID NO: 577043 - DNA, 506 bp, Homo sapiens
  misc_feature: HIJSMM301CKGN6.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtagtttttaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgcc

SEQ ID NO: 577044 - DNA, 487 bp, Homo sapiens; identical to SEQ ID NO: 554782
  misc_feature: HIJSMM301DNWKV.46.35.D02.1.454.light.4.raw

SEQ ID NO: 577045 - DNA, 484 bp, Homo sapiens; identical to SEQ ID NO: 535441
  misc_feature: HIJSMM301BO1X0.26.60.F05.1.454.light.4.raw

SEQ ID NO: 577046 - DNA, 521 bp, Homo sapiens; identical to SEQ ID NO: 538715
  misc_feature: HIJSMM301EOUJO.27.23.C01.1.454.light.4.raw

SEQ ID NO: 577047 - DNA, 503 bp, Homo sapiens; identical to SEQ ID NO: 557698
  misc_feature: HIJSMM301A1X87.4.39.D06.1.454.light.4.raw

SEQ ID NO: 577048 - DNA, 496 bp, Homo sapiens; identical to SEQ ID NO: 551939
  misc_feature: HIJSMM301ASDKI.19.71.G05.1.454.light.4.raw

SEQ ID NO: 577049 - DNA, 509 bp, Homo sapiens; identical to SEQ ID NO: 536047
  misc_feature: HIJSMM301BP4YX.17.33.C11.1.454.light.4.raw

SEQ ID NO: 577050 - DNA, 522 bp, Homo sapiens
  misc_feature: HIJSMM301CTA4P.41.14.B03.1.454.light.4.raw
tctatactatcacgaccggtgctcgatttagtgtgagtagttccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccccactgtcactctgttcccgccct

SEQ ID NO: 577051 - DNA, 492 bp, Homo sapiens
  misc_feature: HIJSMM301CIH40.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcgggactttcggccgaacggaaccgaaggtaggaaagtactaaacgaactgtggctgcaccta

SEQ ID NO: 577052 - DNA, 516 bp, Homo sapiens
  misc_feature: HIJSMM301CV8FD.14.78.H01.1.454.light.4.raw
cgtctagtaccacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgttcccc

SEQ ID NO: 577053 - DNA, 484 bp, Homo sapiens; identical to SEQ ID NO: 535400
  misc_feature: HIJSMM301DBYDN.46.26.C04.1.454.light.4.raw

SEQ ID NO: 577054 - DNA, 501 bp, Homo sapiens
  misc_feature: HIJSMM301BRI5G.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacggagggtgactattactgtcagtctgacaaacaccactgcagcggtgttcggcggagggaccaagctgaccgtcctgcgtcacgccaaggctcgccccctcggtccactctcgttcccta

SEQ ID NO: 577055 - DNA, 485 bp, Homo sapiens; identical to SEQ ID NO: 536576
  misc_feature: HIJSMM301CUOG5.46.35.D02.1.454.light.4.raw

SEQ ID NO: 577056 - DNA, 490 bp, Homo sapiens; identical to SEQ ID NO: 538273
  misc_feature: HIJSMM301D57PY.16.73.G07.1.454.light.4.raw

SEQ ID NO: 577057 - DNA, 481 bp, Homo sapiens; identical to SEQ ID NO: 535314
  misc_feature: HIJSMM301D4RZJ.10.4.A04.1.454.light.4.raw

SEQ ID NO: 577058 - DNA, 504 bp, Homo sapiens
  misc_feature: HIJSMM301B430V.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaaactgaccgtcctaggtcagcccaaggctgccccctcc

SEQ ID NO: 577059 - DNA, 486 bp, Homo sapiens
  misc_feature: HIJSMM301AXB16.49.10.A10.1.454.light.4.raw
agtcgagagacacgaccggtgctcgatttagcgtcgatctcagggcacgaccggtgctcgatttagatcgtctgtgttgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccg

SEQ ID NO: 577060 - DNA, 493 bp, Homo sapiens
  misc_feature: HIJSMM301BQHUM.17.53.E09.1.454.light.4.raw
cgtagactagcacgaccggtgctcgatttagagagagtgtgttgggtttgggggagctgctcagttaggacccagagggaaccatggaaaccccagcgcagcttctcttcctcctgctactctggctcccagatgtcaccggagaagttgtgttgacgcagtctccagccaccctgtctttgtctccaggggaaaagccaccctctcctgctgggccagccagtatgtcagcagtgataatttagcctggtatcagcaaaaacatggccaggctcccaggctcctcatctttggtgcatccagcaggatcactggcgtccctgacaggttcagaggcagggggtctggggacagacttcactctcaccatcaacagactggagcctgaagattttgcaatttattattgtcagcagtatggttcctcaccatctttcggcggagggaccagggtggagatgaatcgaactgtggctgcaccatctgtcttcta

SEQ ID NO: 577061 - DNA, 504 bp, Homo sapiens
  misc_feature: HIJSMM301DIRJ0.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctaagtcagcccaaggctgccccctcggtca

SEQ ID NO: 577062 - DNA, 494 bp, Homo sapiens; identical to SEQ ID NO: 534992
  misc_feature: HIJSMM301D1747.9.1.A01.1.454.light.4.raw

SEQ ID NO: 577063 - DNA, 509 bp, Homo sapiens; identical to SEQ ID NO: 536047
  misc_feature: HIJSMM301AP2TI.17.33.C11.1.454.light.4.raw

SEQ ID NO: 577064 - DNA, 512 bp, Homo sapiens
  misc_feature: HIJSMM301C8TVM.8.39.D06.1.454.light.4.raw
ctcgcgtgtccacgaccggtgctcgatttagtgacatctcgcagttctttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcttacgagggccactggccaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttca

SEQ ID NO: 577065 - DNA, 487 bp, Homo sapiens; identical to SEQ ID NO: 535583
  misc_feature: HIJSMM301A39RN.22.73.G07.1.454.light.4.raw

SEQ ID NO: 577066 - DNA, 487 bp, Homo sapiens; identical to SEQ ID NO: 551272
  misc_feature: HIJSMM301BTHM1.4.59.F04.1.454.light.4.raw

SEQ ID NO: 577067 - DNA, 479 bp, Homo sapiens; identical to SEQ ID NO: 535118
  misc_feature: HIJSMM301ECR8D.13.59.F04.1.454.light.4.raw

SEQ ID NO: 577068 - DNA, 495 bp, Homo sapiens
  misc_feature: HIJSMM301ASGLF.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggaagattaaacgaactgtggctgcaccatctgtctt

SEQ ID NO: 577069 - DNA, 504 bp, Homo sapiens
  misc_feature: HIJSMM301BNBWD.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgtcctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 577070 - DNA, 486 bp, Homo sapiens
  misc_feature: HIJSMM301EYJV0.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcatgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcacg

SEQ ID NO: 577071 - DNA, 486 bp, Homo sapiens; identical to SEQ ID NO: 535043
  misc_feature: HIJSMM301CSTW6.46.35.D02.1.454.light.4.raw

SEQ ID NO: 577072 - DNA, 489 bp, Homo sapiens
  misc_feature: HIJSMM301DALBJ.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtattggctgttcggcggcggaccaagttgaccgtcctacg

SEQ ID NO: 577073 - DNA, 501 bp, Homo sapiens
  misc_feature: HIJSMM301BADJX.13.10.A10.1.454.light.4.raw
tcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacggggcccaggcagaagatgaacctgattattactgtgttctttatatgggtagtgccatttctgctgtgttcggaggaggcacccggctgaccgtcctcggtcagcccaaggctgccccatcggt

SEQ ID NO: 577074 - DNA, 494 bp, Homo sapiens; identical to SEQ ID NO: 534992
  misc_feature: HIJSMM301EQCBR.9.1.A01.1.454.light.4.raw

SEQ ID NO: 577075 - DNA, 505 bp, Homo sapiens
  misc_feature: HIJSMM301C7NRV.18.26.C04.1.454.light.4.raw
  modified_base (475)..(475): a, c, t, g, unknown or other
  modified_base (496)..(496): a, c, t, g, unknown or other
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggaggacgaacggaggaggagacaaacgaactagtgngtcgcaccaatctgtcttctntcttcctcc

SEQ ID NO: 577076 - DNA, 415 bp, Homo sapiens
  misc_feature: HIJSMM301CBFXH.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctgttcccgccctcctcgagtagtaca

SEQ ID NO: 577077 - DNA, 485 bp, Homo sapiens; identical to SEQ ID NO: 536576
  misc_feature: HIJSMM301CB3OK.46.35.D02.1.454.light.4.raw

SEQ ID NO: 577078 - DNA, 487 bp, Homo sapiens; identical to SEQ ID NO: 538190
  misc_feature: HIJSMM301BK3HT.47.70.G04.1.454.light.4.raw

SEQ ID NO: 577079 - DNA, 441 bp, Homo sapiens; identical to SEQ ID NO: 535074
  misc_feature: HIJSMM301B9IBV.11.3.A03.1.454.light.4.raw

SEQ ID NO: 577080 - DNA, 504 bp, Homo sapiens
  misc_feature: HIJSMM301EC10Q.40.41.D08.1.454.light.4.raw
tctagcgactcacgaccggtgctcgatttagtcacgcgagaaagggaaaaggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagaccccg

SEQ ID NO: 577081 - DNA, 494 bp, Homo sapiens; identical to SEQ ID NO: 534994
  misc_feature: HIJSMM301BYNAZ.27.78.H01.1.454.light.4.raw

SEQ ID NO: 577082 - DNA, 466 bp, Homo sapiens
  misc_feature: HIJSMM301BDUPB.4.39.D06.1.454.light.4.raw
agcactgtagcacgaccggtgctcgatttagtgacatctcgcagttctttggggcttctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttaattggacgttcggcctaggggaccaaggttcgaaaatgagacgaactgtggctgcaccatctgtcttcatcttcccgccatctgactacagtgct

SEQ ID NO: 577083 - DNA, 503 bp, Homo sapiens
  misc_feature: HIJSMM301DYEON.21.22.B11.1.454.light.4.raw
  modified_base (430)..(430): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggcctccggtccgaggatgaggctgactattactgtgcatcacgggacncaacatgggatgacaatctgagcggttgggtgttcggcggaggaccaaactgaccgtcctaggtccagcccaa

SEQ ID NO: 577084 - DNA, 485 bp, Homo sapiens
  misc_feature: HIJSMM301AG6P2.49.86.H09.1.454.light.4.raw
agtcgagagacacgaccggtgctcgatttagtgctatagacttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaaacg

SEQ ID NO: 577085 - DNA, 520 bp, Homo sapiens; identical to SEQ ID NO: 546218
  misc_feature: HIJSMM301AWCE4.12.71.G05.1.454.light.4.raw

SEQ ID NO: 577086 - DNA, 489 bp, Homo sapiens
  misc_feature: HIJSMM301EOHOA.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctactttattgctgtcagcagcgtagcaactggcctctcactttcggcggagggaccgagggtggagatcagacgaactgtggctgcaccat

SEQ ID NO: 577087 - DNA, 511 bp, Homo sapiens
  misc_feature: HIJSMM301CMJS7.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccacgggaccgacacgtagaaatagagacgaactacgtggcgtgcgaccactctgtcttctatcttcccgt

SEQ ID NO: 577088 - DNA, 477 bp, Homo sapiens; identical to SEQ ID NO: 535506
  misc_feature: HIJSMM301DFM9I.7.67.G01.1.454.light.4.raw

SEQ ID NO: 577089 - DNA, 473 bp, Homo sapiens
  misc_feature: HIJSMM301B8LFU.4.75.G09.1.454.light.4.raw
agcactgtagcacgaccggtgctcgatttagtatagacatcagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcagacccg

SEQ ID NO: 577090 - DNA, 497 bp, Homo sapiens; identical to SEQ ID NO: 535286
  misc_feature: HIJSMM301CWBBJ.18.59.F04.1.454.light.4.raw

SEQ ID NO: 577091 - DNA, 503 bp, Homo sapiens
  misc_feature: HIJSMM301B4IBB.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaagccaactccactgtcact

SEQ ID NO: 577092 - DNA, 469 bp, Homo sapiens
  misc_feature: HIJSMM301AOLN5.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccacggggaccgaaagtggagtgtcaaccgaa

SEQ ID NO: 577093 - DNA, 494 bp, Homo sapiens; identical to SEQ ID NO: 534994
  misc_feature: HIJSMM301C9FRO.27.78.H01.1.454.light.4.raw

SEQ ID NO: 577094 - DNA, 479 bp, Homo sapiens; identical to SEQ ID NO: 542015
  misc_feature: HIJSMM301B6A0D.4.11.A11.1.454.light.4.raw

SEQ ID NO: 577095 - DNA, 473 bp, Homo sapiens; identical to SEQ ID NO: 539624
  misc_feature: HIJSMM301BLIAL.3.38.D05.1.454.light.4.raw

SEQ ID NO: 577096 - DNA, 468 bp, Homo sapiens
  misc_feature: HIJSMM301EALU8.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgagattttgcaacttactattgtcaacaggctgacagtctcccgctcactttcggcggagggaccaaggtggagatcaaacgaa

SEQ ID NO: 577097 - DNA, 497 bp, Homo sapiens; identical to SEQ ID NO: 546781
  misc_feature: HIJSMM301EB9JN.43.28.C06.1.454.light.4.raw

SEQ ID NO: 577098 - DNA, 496 bp, Homo sapiens
  misc_feature: HIJSMM301DMMQQ.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatacaaacgaactagtggctgcaccatctgtcttcat

SEQ ID NO: 577099 - DNA, 487 bp, Homo sapiens
  misc_feature: HIJSMM301DQUC3.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactagaaaatcagcagagtggaggctgaggatgttgggctctattattgcatgcaagctctacaagtcccgctcactttcggcggagggaccgaaggtggagatacaaacgaa

SEQ ID NO: 577100 - DNA, 493 bp, Homo sapiens; identical to SEQ ID NO: 539456
  misc_feature: HIJSMM301B2CTD.10.79.H02.1.454.light.4.raw

SEQ ID NO: 577101 - DNA, 441 bp, Homo sapiens; identical to SEQ ID NO: 535074
  misc_feature: HIJSMM301DXYMZ.11.3.A03.1.454.light.4.raw

SEQ ID NO: 577102 - DNA, 471 bp, Homo sapiens
  misc_feature: HIJSMM301EAI1D.51.67.G01.1.454.light.4.raw
cgatcgtatacacgaccggtgctcgatttagagtatacatattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagatttttactttcaccatcagcaggctgcagcctgaagacattgcaacatattactgtcaacagtatgatagtctcccgctcactttcggcggggggaccgaaggtggagatcaagcgaa

SEQ ID NO: 577103 - DNA, 504 bp, Homo sapiens
  misc_feature: HIJSMM301D34YB.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggaggaccaaggtggacctcaaacgaactgtggctgcaccatctgtcttcatcttcccgcc

SEQ ID NO: 577104 - DNA, 490 bp, Homo sapiens
  misc_feature: HIJSMM301CQX0F.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaacgaactgtggctgcaccatctgtcttcatt

SEQ ID NO: 577105 - DNA, 498 bp, Homo sapiens
  misc_feature: HIJSMM301CP8QY.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgacaaggtcacgtcctgggtcagcccaaggcccaaaccccactgtcactcttccg

SEQ ID NO: 577106 - DNA, 472 bp, Homo sapiens; identical to SEQ ID NO: 536302
  misc_feature: HIJSMM301BA8BZ.18.76.G10.1.454.light.4.raw

SEQ ID NO: 577107 - DNA, 482 bp, Homo sapiens; identical to SEQ ID NO: 535352
  misc_feature: HIJSMM301DNKKC.16.81.H04.1.454.light.4.raw

SEQ ID NO: 577108 - DNA, 494 bp, Homo sapiens; identical to SEQ ID NO: 534994
  misc_feature: HIJSMM301CBZBD.27.78.H01.1.454.light.4.raw

SEQ ID NO: 577109 - DNA, 512 bp, Homo sapiens
  misc_feature: HIJSMM301EJSF1.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctgccccctggtcactctgttcccg

SEQ ID NO: 577110 - DNA, 487 bp, Homo sapiens; identical to SEQ ID NO: 562900
  misc_feature: HIJSMM301DV17K.46.35.D02.1.454.light.4.raw

SEQ ID NO: 577111 - DNA, 510 bp, Homo sapiens
  misc_feature: HIJSMM301DJEM4.48.35.D02.1.454.light.4.raw
agtatacatacacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagttttatactgtcagcactgttttggcggttctccgactttcggcggagggaccgaaggtggaggtcaaacgaactgtggcgtgcaccatctgtctt

SEQ ID NO: 577112 - DNA, 494 bp, Homo sapiens
  misc_feature: HIJSMM301DM1VO.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttttactgtcagcagtatagtaactggcctccgtacacttttggccaggggaccaagctagaaatcaaacgaactgtggctgcaccatctgtcttca

SEQ ID NO: 577113 - DNA, 471 bp, Homo sapiens; identical to SEQ ID NO: 539429
  misc_feature: HIJSMM301CR4EQ.13.48.E04.1.454.light.4.raw

SEQ ID NO: 577114 - DNA, 485 bp, Homo sapiens; identical to SEQ ID NO: 535822
  misc_feature: HIJSMM301A3J64.14.53.E09.1.454.light.4.raw

SEQ ID NO: 577115 - DNA, 490 bp, Homo sapiens; identical to SEQ ID NO: 535526
  misc_feature: HIJSMM301DJPIK.26.78.H01.1.454.light.4.raw

SEQ ID NO: 577116 - DNA, 423 bp, Homo sapiens
  misc_feature: HIJSMM301EC4WB.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaaggccaaccccactgtcactctgttcccgccctcctcagacgtatca

SEQ ID NO: 577117 - DNA, 447 bp, Homo sapiens; identical to SEQ ID NO: 535201
  misc_feature: HIJSMM301APHCZ.18.9.A09.1.454.light.4.raw

SEQ ID NO: 577118 - DNA, 494 bp, Homo sapiens; identical to SEQ ID NO: 534994
  misc_feature: HIJSMM301BU4PZ.27.78.H01.1.454.light.4.raw

SEQ ID NO: 577119 - DNA, 490 bp, Homo sapiens; identical to SEQ ID NO: 541141
  misc_feature: HIJSMM301BMPD9.47.38.D05.1.454.light.4.raw

SEQ ID NO: 577120 - DNA, 484 bp, Homo sapiens; identical to SEQ ID NO: 535287
  misc_feature: HIJSMM301DTMVY.13.56.F01.1.454.light.4.raw

SEQ ID NO: 577121 - DNA, 501 bp, Homo sapiens; identical to SEQ ID NO: 548482
  misc_feature: HIJSMM301BPNMC.41.71.G05.1.454.light.4.raw

SEQ ID NO: 577122 - DNA, 501 bp, Homo sapiens; identical to SEQ ID NO: 536867
  misc_feature: HIJSMM301CQ7QJ.5.86.H09.1.454.light.4.raw

SEQ ID NO: 577123 - DNA, 508 bp, Homo sapiens
  misc_feature: HIJSMM301BI7FD.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgcccctcggtcactctgttcccaccctcctcgctacgtaga

SEQ ID NO: 577124 - DNA, 488 bp, Homo sapiens; identical to SEQ ID NO: 535081
  misc_feature: HIJSMM301EVACB.26.23.C01.1.454.light.4.raw

SEQ ID NO: 577125 - DNA, 518 bp, Homo sapiens
  misc_feature: HIJSMM301A78B4.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccaggtgaccgtcctaggtcagcccaaggctgccccctcggtcactctgttcccta

SEQ ID NO: 577126 - DNA, 480 bp, Homo sapiens; identical to SEQ ID NO: 535291
  misc_feature: HIJSMM301EHRC9.22.59.F04.1.454.light.4.raw

SEQ ID NO: 577127 - DNA, 513 bp, Homo sapiens; identical to SEQ ID NO: 549699
  misc_feature: HIJSMM301BNDEO.40.12.B01.1.454.light.4.raw

SEQ ID NO: 577128 - DNA, 504 bp, Homo sapiens
  misc_feature: HIJSMM301DMRYZ.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctcggggccactttcggccctgggaccaaggtggagatcaacgaactgtggctgcaccatctgtcttcta

SEQ ID NO: 577129 - DNA, 503 bp, Homo sapiens; identical to SEQ ID NO: 538884
  misc_feature: HIJSMM301ASHFZ.27.78.H01.1.454.light.4.raw

SEQ ID NO: 577130 - DNA, 494 bp, Homo sapiens; identical to SEQ ID NO: 534992
  misc_feature: HIJSMM301ATZ7D.9.1.A01.1.454.light.4.raw

SEQ ID NO: 577131 - DNA, 490 bp, Homo sapiens
  misc_feature: HIJSMM301CM51G.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggacaaggcggagatacagacgaactagtggctgcaccatctgtcttcta

SEQ ID NO: 577132 - DNA, 520 bp, Homo sapiens; identical to SEQ ID NO: 546218
  misc_feature: HIJSMM301D0P7D.12.71.G05.1.454.light.4.raw

SEQ ID NO: 577133 - DNA, 506 bp, Homo sapiens; identical to SEQ ID NO: 563474
  misc_feature: HIJSMM301AKR5I.10.27.C05.1.454.light.4.raw

SEQ ID NO: 577134 - DNA, 503 bp, Homo sapiens; identical to SEQ ID NO: 568855
  misc_feature: HIJSMM301EP2ZQ.9.71.G05.1.454.light.4.raw

SEQ ID NO: 577135 - DNA, 487 bp, Homo sapiens
  misc_feature: HIJSMM301EJM4C.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtgctgcaccatctgtt

SEQ ID NO: 577136 - DNA, 523 bp, Homo sapiens
  misc_feature: HIJSMM301BTVO8.40.27.C05.1.454.light.4.raw
  modified_base (203)..(203): a, c, t, g, unknown or other
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgacgaccccccgggnagcaggtttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccccggccatcagtgggctccggcccgaggatgaggcggattattattgtgtgtcatgggatgacagaatgaatggtccggtgttcggcggagggaccaggctgtccgtcctaggtcagcccaaggctgccccctcggtcactctgtt

SEQ ID NO: 577137 - DNA, 512 bp, Homo sapiens
  misc_feature: HIJSMM301DZN6H.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccaggtggtgttcggcggagggaccaagctggccgtcctaggtcagcccaaggctgccccctggtcactctgttcccaccctcctcgagtagtaca

SEQ ID NO: 577138 - DNA, 500 bp, Homo sapiens
  misc_feature: HIJSMM301AKBJ9.43.87.H10.1.454.light.4.raw
tgtgagtagtcacgaccggtgctcgatttagcagtactgcgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 577139 - DNA, 496 bp, Homo sapiens; identical to SEQ ID NO: 537925
  misc_feature: HIJSMM301AUI3O.22.14.B03.1.454.light.4.raw

SEQ ID NO: 577140 - DNA, 475 bp, Homo sapiens; identical to SEQ ID NO: 562103
  misc_feature: HIJSMM301EEV7B.13.76.G10.1.454.light.4.raw

SEQ ID NO: 577141 - DNA, 486 bp, Homo sapiens; identical to SEQ ID NO: 535043
  misc_feature: HIJSMM301BQPZ4.46.35.D02.1.454.light.4.raw

SEQ ID NO: 577142 - DNA, 486 bp, Homo sapiens
  misc_feature: HIJSMM301DW50Y.21.55.E11.1.454.light.4.raw
tcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtatcctttcactttcggccctgggaccgaagtcgatatcaaacgaactgtggctgcaccatctgt

SEQ ID NO: 577143 - DNA, 494 bp, Homo sapiens
  misc_feature: HIJSMM301E0VLO.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgactcaccttcggccgaacggacgacgactggagattaaacgaaactgtggctgcaccatctgtcttcatt

SEQ ID NO: 577144 - DNA, 494 bp, Homo sapiens; identical to SEQ ID NO: 539894
  misc_feature: HIJSMM301D68OF.16.53.E09.1.454.light.4.raw

SEQ ID NO: 577145 - DNA, 497 bp, Homo sapiens; identical to SEQ ID NO: 548828
  misc_feature: HIJSMM301AZXUT.9.39.D06.1.454.light.4.raw

SEQ ID NO: 577146 - DNA, 497 bp, Homo sapiens
  misc_feature: HIJSMM301AFLWN.48.58.F03.1.454.light.4.raw
agtatacatacacgaccggtgctcgatttagtctgatcgagaagggaaagggggaggttctttcttctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgagttcagtggcagtggatctgggacagatttcaccctcaccatcaatagcctggaagctgaagatgctgcaacctattactgtcatcagtacttttagtttacgtcggaccttcggccaagggacacgctaggagattaaacgaactgtgg

SEQ ID NO: 577147 - DNA, 496 bp, Homo sapiens; identical to SEQ ID NO: 545011
  misc_feature: HIJSMM301ETV3N.22.86.H09.1.454.light.4.raw

SEQ ID NO: 577148 - DNA, 494 bp, Homo sapiens; identical to SEQ ID NO: 534992
  misc_feature: HIJSMM301BPQND.9.1.A01.1.454.light.4.raw

SEQ ID NO: 577149 - DNA, 464 bp, Homo sapiens; identical to SEQ ID NO: 539492
  misc_feature: HIJSMM301AOQC0.18.59.F04.1.454.light.4.raw

SEQ ID NO: 577150 - DNA, 497 bp, Homo sapiens
  misc_feature: HIJSMM301D6P5E.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcaggggacccaggccttggatgaggctgactatcactgtcaggcgtgggacagcaacactgcgattttcggcgggggaccaggctgaccgtcggcggtcagccaaggctgccccctcggtcactctgttcccg

SEQ ID NO: 577151 - DNA, 493 bp, Homo sapiens
  misc_feature: HIJSMM301B6MP2.10.25.C03.1.454.light.4.raw
catagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctgggacagagttcgctctcaccatcagcagtctgcagtctgaagattttgctagtttattactgtcaggaatatgatggctggcctccgtacacttttggccaagggaccaagttggacatacaaacgaactgtgg

SEQ ID NO: 577152 - DNA, 496 bp, Homo sapiens; identical to SEQ ID NO: 536248
  misc_feature: HIJSMM301CR845.22.27.C05.1.454.light.4.raw

SEQ ID NO: 577153 - DNA, 484 bp, Homo sapiens
  misc_feature: HIJSMM301DZG8E.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaaactgtggctgcaccatct

SEQ ID NO: 577154 - DNA, 496 bp, Homo sapiens; identical to SEQ ID NO: 535541
  misc_feature: HIJSMM301EWZ6G.3.33.C11.1.454.light.4.raw

SEQ ID NO: 577155 - DNA, 485 bp, Homo sapiens; identical to SEQ ID NO: 535880
  misc_feature: HIJSMM301CN6YS.7.75.G09.1.454.light.4.raw

SEQ ID NO: 577156 - DNA, 481 bp, Homo sapiens
  misc_feature: HIJSMM301BY0P7.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtgggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccat

SEQ ID NO: 577157 - DNA, 447 bp, Homo sapiens; identical to SEQ ID NO: 535020
  misc_feature: HIJSMM301EA21T.18.9.A09.1.454.light.4.raw

SEQ ID NO: 577158 - DNA, 500 bp, Homo sapiens
  misc_feature: HIJSMM301B78YR.52.35.D02.1.454.light.4.raw
cgcagtacgacacgaccggtgctcgatttagcacacgatagttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagatttgcagtttattactgtcagcagcgtagccactggctctctttcggcggagggaccaaggttgagatcaaacgaactgtggctgcaccatctgtcttcatcttccccg

SEQ ID NO: 577159 - DNA, 517 bp, Homo sapiens
  misc_feature: HIJSMM301AXYK6.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgctagtttattactgtcaacatcgtaccgagtggccgtccgggggcctacgtttccggcccgtcgggaccgaaggtggagatacaaacgaactgtggctgcaccatctgtcttctatt

SEQ ID NO: 577160 - DNA, 503 bp, Homo sapiens; identical to SEQ ID NO: 535044
  misc_feature: HIJSMM301BW9Z7.19.78.H01.1.454.light.4.raw

SEQ ID NO: 577161 - DNA, 499 bp, Homo sapiens
  misc_feature: HIJSMM301A6WDY.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctcgccccctcggt

SEQ ID NO: 577162 - DNA, 485 bp, Homo sapiens; identical to SEQ ID NO: 536799
  misc_feature: HIJSMM301CADOD.19.71.G05.1.454.light.4.raw

SEQ ID NO: 577163 - DNA, 499 bp, Homo sapiens; identical to SEQ ID NO: 543588
  misc_feature: HIJSMM301C4DEC.19.78.H01.1.454.light.4.raw

SEQ ID NO: 577164 - DNA, 495 bp, Homo sapiens; identical to SEQ ID NO: 535596
  misc_feature: HIJSMM301AN7T8.10.79.H02.1.454.light.4.raw

SEQ ID NO: 577165 - DNA, 451 bp, Homo sapiens
  misc_feature: HIJSMM301DD0Y0.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgacccccaaactcctcattctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccgccctcctccatactcgta

SEQ ID NO: 577166 - DNA, 506 bp, Homo sapiens; identical to SEQ ID NO: 542696
  misc_feature: HIJSMM301EIXGL.7.71.G05.1.454.light.4.raw

SEQ ID NO: 577167 - DNA, 494 bp, Homo sapiens
  misc_feature: HIJSMM301BVEPH.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagattcttcttaccctcggtacgtcgtcgacgggaccgacggtcggagtgtcagacgactacgtgtcgtgcgaccactctcg

SEQ ID NO: 577168 - DNA, 486 bp, Homo sapiens
  misc_feature: HIJSMM301DRXWI.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaactcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtacacttttggccaggggaccaaactggacatcaaacgaactgtggctgcaccatctgtt

SEQ ID NO: 577169 - DNA, 514 bp, Homo sapiens
  misc_feature: HIJSMM301DEDRD.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtccggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgccctccctcaccatctctggactgaagactgaggacgaggctgactactactgtcagtcttatgataacaccagggtggtgttcggcggagggccaagctgaccgtcctaggtcagcccaaggctgccccctggtcactctgttcccaccctcctcgagtagtaca

SEQ ID NO: 577170 - DNA, 520 bp, Homo sapiens; identical to SEQ ID NO: 567791
  misc_feature: HIJSMM301BBQAJ.27.23.C01.1.454.light.4.raw

SEQ ID NO: 577171 - DNA, 508 bp, Homo sapiens
  misc_feature: HIJSMM301ETN08.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatcaaacgaaactgtggctgcaccatctgtt

SEQ ID NO: 577172 - DNA, 490 bp, Homo sapiens
  misc_feature: HIJSMM301BSVZ7.3.37.D04.1.454.light.4.raw
agacgcactccacgaccggtgctcgatttagtagcatactgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacacggcctccctgaccgtctctggctccagcctgaggatgaggctgattattactgcagctcatatgcaggcatcaacactgttttcggcggagggaccaagctgaccgtcctaggtcagcccaaggct

SEQ ID NO: 577173 - DNA, 499 bp, Homo sapiens; identical to SEQ ID NO: 575204
  misc_feature: HIJSMM301B5M97.5.24.C02.1.454.light.4.raw

SEQ ID NO: 577174 - DNA, 465 bp, Homo sapiens
  misc_feature: HIJSMM301BW4NK.48.73.G07.1.454.light.4.raw
agtatacatacacgaccggtgctcgatttagctctacgctcagggcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccag

SEQ ID NO: 577175 - DNA, 491 bp, Homo sapiens
  misc_feature: HIJSMM301CYAER.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatccaccttcggccaagggacacgactggagattaaacgaactgtggctgcacatctgtcttcatt

SEQ ID NO: 577176 - DNA, 505 bp, Homo sapiens; identical to SEQ ID NO: 538422
  misc_feature: HIJSMM301CWXNN.19.78.H01.1.454.light.4.raw

SEQ ID NO: 577177 - DNA, 496 bp, Homo sapiens; identical to SEQ ID NO: 535109
  misc_feature: HIJSMM301A0XTW.16.78.H01.1.454.light.4.raw

SEQ ID NO: 577178 - DNA, 501 bp, Homo sapiens; identical to SEQ ID NO: 535746
  misc_feature: HIJSMM301D2HLL.18.11.A11.1.454.light.4.raw

SEQ ID NO: 577179 - DNA, 502 bp, Homo sapiens; identical to SEQ ID NO: 539314
  misc_feature: HIJSMM301EZ6CQ.21.81.H04.1.454.light.4.raw

SEQ ID NO: 577180 - DNA, 488 bp, Homo sapiens; identical to SEQ ID NO: 536554
  misc_feature: HIJSMM301AL28D.26.37.D04.1.454.light.4.raw

SEQ ID NO: 577181 - DNA, 505 bp, Homo sapiens
  misc_feature: HIJSMM301DPCGO.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaaacgtggatatcaaacgaactagtggctgcaccatctgtt

SEQ ID NO: 577182 - DNA, 504 bp, Homo sapiens; identical to SEQ ID NO: 576137
  misc_feature: HIJSMM301CIKBG.19.78.H01.1.454.light.4.raw

SEQ ID NO: 577183 - DNA, 477 bp, Homo sapiens; identical to SEQ ID NO: 535506
  misc_feature: HIJSMM301A1AMQ.7.67.G01.1.454.light.4.raw

SEQ ID NO: 577184 - DNA, 454 bp, Homo sapiens; identical to SEQ ID NO: 534964
  misc_feature: HIJSMM301DIC5K.19.86.H09.1.454.light.4.raw

SEQ ID NO: 577185 - DNA, 463 bp, Homo sapiens; identical to SEQ ID NO: 535008
  misc_feature: HIJSMM301DU6GU.10.9.A09.1.454.light.4.raw

SEQ ID NO: 577186 - DNA, 501 bp, Homo sapiens; identical to SEQ ID NO: 536818
  misc_feature: HIJSMM301C6FY9.12.82.H05.1.454.light.4.raw

SEQ ID NO: 577187 - DNA, 493 bp, Homo sapiens; identical to SEQ ID NO: 543036
  misc_feature: HIJSMM301ANZW2.43.61.F06.1.454.light.4.raw

SEQ ID NO: 577188 - DNA, 518 bp, Homo sapiens
  misc_feature: HIJSMM301AQ4TE.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtccactctgttcccg

SEQ ID NO: 577189 - DNA, 497 bp, Homo sapiens; identical to SEQ ID NO: 536371
  misc_feature: HIJSMM301BRN32.16.78.H01.1.454.light.4.raw

SEQ ID NO: 577190 - DNA, 496 bp, Homo sapiens; identical to SEQ ID NO: 537925
  misc_feature: HIJSMM301ATL2F.22.14.B03.1.454.light.4.raw

SEQ ID NO: 577191 - DNA, 503 bp, Homo sapiens
  misc_feature: HIJSMM301D182P.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctcactgaccatctcggggctccaggctgaggacgaggctgcttattactgcagctcatatacaaggagcaccactctcgtggtatttggtggagggaccaagctgaccgtcctaggtcagcccaaggctgccccctc

SEQ ID NO: 577192 - DNA, 490 bp, Homo sapiens; identical to SEQ ID NO: 538927
  misc_feature: HIJSMM301CJNVI.10.77.G11.1.454.light.4.raw

SEQ ID NO: 577193 - DNA, 460 bp, Homo sapiens; identical to SEQ ID NO: 536053
  misc_feature: HIJSMM301COV3K.22.28.C06.1.454.light.4.raw

SEQ ID NO: 577194 - DNA, 497 bp, Homo sapiens; identical to SEQ ID NO: 552235
  misc_feature: HIJSMM301DBPOW.22.86.H09.1.454.light.4.raw

SEQ ID NO: 577195 - DNA, 441 bp, Homo sapiens; identical to SEQ ID NO: 535074
  misc_feature: HIJSMM301D1M92.11.3.A03.1.454.light.4.raw

SEQ ID NO: 577196 - DNA, 494 bp, Homo sapiens; identical to SEQ ID NO: 534994
  misc_feature: HIJSMM301DOCAW.27.78.H01.1.454.light.4.raw

SEQ ID NO: 577197 - DNA, 500 bp, Homo sapiens
  misc_feature: HIJSMM301EA57U.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtggatcaggcactgatttcacactggaaatcagcagggtggaggctgaggatgttggggtttattactgcatgcaaactacacacggccgctcactttcggcggagggaccaaggtggagatcaaacgaactgtggctgcacat

SEQ ID NO: 577198 - DNA, 489 bp, Homo sapiens; identical to SEQ ID NO: 535139
  misc_feature: HIJSMM301DATL7.14.55.E11.1.454.light.4.raw

SEQ ID NO: 577199 - DNA, 495 bp, Homo sapiens
  misc_feature: HIJSMM301BMZZV.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattacttgtcagtcagcgtagcaactggcctctcactttcggcggagggaccagggtggagagtcagacgaactgtggctgcaccatctgtt

SEQ ID NO: 577200 - DNA, 485 bp, Homo sapiens
  misc_feature: HIJSMM301ET2O7.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcagacgaactgtggctgca

SEQ ID NO: 577201 - DNA, 478 bp, Homo sapiens; identical to SEQ ID NO: 563839
  misc_feature: HIJSMM301DDQTV.13.11.A11.1.454.light.4.raw

SEQ ID NO: 577202 - DNA, 504 bp, Homo sapiens; identical to SEQ ID NO: 547861
  misc_feature: HIJSMM301C99FQ.5.68.G02.1.454.light.4.raw

SEQ ID NO: 577203 - DNA, 486 bp, Homo sapiens; identical to SEQ ID NO: 539826
  misc_feature: HIJSMM301AYFU5.5.23.C01.1.454.light.4.raw

SEQ ID NO: 577204 - DNA, 517 bp, Homo sapiens
  misc_feature: HIJSMM301DEIBR.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctacggtcagcccaaggcccaaccccactgtcactctgttcccaccctcctcgacc

SEQ ID NO: 577205 - DNA, 499 bp, Homo sapiens; identical to SEQ ID NO: 547044
  misc_feature: HIJSMM301CE4LP.43.71.G05.1.454.light.4.raw

SEQ ID NO: 577206 - DNA, 383 bp, Homo sapiens; identical to SEQ ID NO: 447524
  misc_feature: HIJSMM301CQ6XN.41.26.C04.1.454.light.4.raw

SEQ ID NO: 577207 - DNA, 508 bp, Homo sapiens
  misc_feature: HIJSMM301DK7ZO.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctcgccccctcggt

SEQ ID NO: 577208 - DNA, 477 bp, Homo sapiens
  misc_feature: HIJSMM301BZCBH.53.7.A07.1.454.light.4.raw
cgcgtatacacacgaccggtgctcgatttagcacgtgtcgcaggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcacgttatgatgtacactggtaccagcaccttccaggagcacgcccccaacctcctcctctctggtaacaccaatccggccctcacggggtccctgaccgattctctggctcgaagtctggcacctcagcctccctggccatcactggcctccaggctgaggatgaggctgattattactgccagtcctatgacagcagcctgaatgcttatgtcttcggaactgggacctaa

SEQ ID NO: 577209 - DNA, 498 bp, Homo sapiens; identical to SEQ ID NO: 537020
  misc_feature: HIJSMM301BVATR.26.26.C04.1.454.light.4.raw

SEQ ID NO: 577210 - DNA, 488 bp, Homo sapiens
  misc_feature: HIJSMM301EHAFE.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggataatcagacgaa

SEQ ID NO: 577211 - DNA, 484 bp, Homo sapiens; identical to SEQ ID NO: 535400
  misc_feature: HIJSMM301BOJIO.46.26.C04.1.454.light.4.raw

SEQ ID NO: 577212 - DNA, 487 bp, Homo sapiens; identical to SEQ ID NO: 536986
  misc_feature: HIJSMM301D7WZO.3.12.B01.1.454.light.4.raw

SEQ ID NO: 577213 - DNA, 503 bp, Homo sapiens
  misc_feature: HIJSMM301BLZF4.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccgaaagtggagatcaaacgaactgtggctgcaccatctgtcttcta

SEQ ID NO: 577214 - DNA, 494 bp, Homo sapiens
  misc_feature: HIJSMM301BS7XQ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggtccaagggacacgactggagattaaacgaaactgtggctgcaccatctcgt

SEQ ID NO: 577215 - DNA, 497 bp, Homo sapiens; identical to SEQ ID NO: 536376
  misc_feature: HIJSMM301DERLR.22.9.A09.1.454.light.4.raw

SEQ ID NO: 577216 - DNA, 488 bp, Homo sapiens; identical to SEQ ID NO: 539612
  misc_feature: HIJSMM301A7UF0.3.55.E11.1.454.light.4.raw

SEQ ID NO: 577217 - DNA, 501 bp, Homo sapiens; identical to SEQ ID NO: 573854
  misc_feature: HIJSMM301D91NL.18.59.F04.1.454.light.4.raw

SEQ ID NO: 577218 - DNA, 503 bp, Homo sapiens
  misc_feature: HIJSMM301B089B.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaaggaccgaaggtggaaatcaaacgaactgtggcgtgcaccatctgtcttcatcttccccg

SEQ ID NO: 577219 - DNA, 513 bp, Homo sapiens; identical to SEQ ID NO: 543780
  misc_feature: HIJSMM301A9AD2.17.33.C11.1.454.light.4.raw

SEQ ID NO: 577220 - DNA, 502 bp, Homo sapiens
  misc_feature: HIJSMM301DFBJ4.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtactttttcggcggagggaccaagctgaccgtcctaggtcagcccaaggctgccccctcggtcactctgttcccaccctcctcgctacgtaga

SEQ ID NO: 577221 - DNA, 479 bp, Homo sapiens
  misc_feature: HIJSMM301ENL84.48.57.F02.1.454.light.4.raw
agtatacatacacgaccggtgctcgatttagctcgatatagttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagacccg

SEQ ID NO: 577222 - DNA, 489 bp, Homo sapiens; identical to SEQ ID NO: 546315
  misc_feature: HIJSMM301ARCYG.43.33.C11.1.454.light.4.raw

SEQ ID NO: 577223 - DNA, 502 bp, Homo sapiens
  misc_feature: HIJSMM301CA8SL.9.53.E09.1.454.light.4.raw
tgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccccg

SEQ ID NO: 577224 - DNA, 493 bp, Homo sapiens
  misc_feature: HIJSMM301D342B.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtctacgtcagcccaaggccaacccca

SEQ ID NO: 577225 - DNA, 496 bp, Homo sapiens
  misc_feature: HIJSMM301BMKLU.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccagcaacacccaggcaaagcccccaaactcatcgtttatgatgtcactgatcggccctcaggggtttctagtcgcttctctggctccaagtctggcaacacggcctccctgaccatctctgggctccaggctgaggacgaggctgattattactgcagctcatatgcaggcagttacaatgtgatattcggcggagggaccaaactgaccgtcctaggtcagcccaaggctcg

SEQ ID NO: 577226 - DNA, 522 bp, Homo sapiens; identical to SEQ ID NO: 540226
  misc_feature: HIJSMM301BF7RN.27.23.C01.1.454.light.4.raw

SEQ ID NO: 577227 - DNA, 515 bp, Homo sapiens; identical to SEQ ID NO: 543484
  misc_feature: HIJSMM301AWZBF.14.19.B08.1.454.light.4.raw

SEQ ID NO: 577228 - DNA, 511 bp, Homo sapiens; identical to SEQ ID NO: 549837
  misc_feature: HIJSMM301ERF9E.15.34.D01.1.454.light.4.raw

SEQ ID NO: 577229 - DNA, 488 bp, Homo sapiens; identical to SEQ ID NO: 544442
  misc_feature: HIJSMM301EMI8O.19.57.F02.1.454.light.4.raw

SEQ ID NO: 577230 - DNA, 302 bp, Homo sapiens; identical to SEQ ID NO: 564509
  misc_feature: HIJSMM301EUA9E.13.11.A11.1.454.light.4.raw

SEQ ID NO: 577231 - DNA, 481 bp, Homo sapiens; identical to SEQ ID NO: 535993
  misc_feature: HIJSMM301EPX0B.21.25.C03.1.454.light.4.raw

SEQ ID NO: 577232 - DNA, 517 bp, Homo sapiens; identical to SEQ ID NO: 536980
  misc_feature: HIJSMM301DPSZB.5.27.C05.1.454.light.4.raw

SEQ ID NO: 577233 - DNA, 503 bp, Homo sapiens
  misc_feature: HIJSMM301DS63X.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaggaccaaggtggaaagtacaaacgaactagtggctgcaccatctgtcttcatcttccccg

SEQ ID NO: 577234 - DNA, 496 bp, Homo sapiens
  misc_feature: HIJSMM301CXPMJ.11.81.H04.1.454.light.4.raw
  modified_base (404)..(404): a, c, t, g, unknown or other
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttacngtcagcagtatagtaactggcctccgtacacttttggccaggggaccaagctagaaatcaaaacgaactgtggctgcaccatctgtcttcta

SEQ ID NO: 577235 - DNA, 489 bp, Homo sapiens; identical to SEQ ID NO: 535139
  misc_feature: HIJSMM301AKD0A.14.55.E11.1.454.light.4.raw

SEQ ID NO: 577236 - DNA, 509 bp, Homo sapiens
  misc_feature: HIJSMM301EKD73.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaagctgaccgtcctaggtcagcccaaggctgccccctcggtcactctcg

SEQ ID NO: 577237 - DNA, 505 bp, Homo sapiens; identical to SEQ ID NO: 535503
  misc_feature: HIJSMM301BQYGF.8.28.C06.1.454.light.4.raw

SEQ ID NO: 577238 - DNA, 519 bp, Homo sapiens
  misc_feature: HIJSMM301EN4DY.3.87.H10.1.454.light.4.raw
agacgcactccacgaccggtgctcgatttagcagtactgcgttgggtttggggggggtcgtcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcactc

SEQ ID NO: 577239 - DNA, 480 bp, Homo sapiens; identical to SEQ ID NO: 535630
  misc_feature: HIJSMM301EVC6L.40.59.F04.1.454.light.4.raw

SEQ ID NO: 577240 - DNA, 500 bp, Homo sapiens; identical to SEQ ID NO: 539795
  misc_feature: HIJSMM301EBCXB.22.38.D05.1.454.light.4.raw

SEQ ID NO: 577241 - DNA, 521 bp, Homo sapiens; identical to SEQ ID NO: 539470
  misc_feature: HIJSMM301DI6HQ.27.23.C01.1.454.light.4.raw

SEQ ID NO: 577242 - DNA, 491 bp, Homo sapiens
  misc_feature: HIJSMM301AJ0WW.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaactttattactgccaacagtatcatcatcattgtaatttcggtggagggaccaaggtggaggtcaaacgaactgtggctgcaccatctgtcttcat

SEQ ID NO: 577243 - DNA, 509 bp, Homo sapiens
  misc_feature: HIJSMM301CVSLJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggacccgaaggtggaaagtacaaacgaaactgtggctggcaccatctgtcttcactcttccccg

SEQ ID NO: 577244 - DNA, 485 bp, Homo sapiens
  misc_feature: HIJSMM301AOSSH.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaaattattactgctgctcatatgaaggttataaacactatactattcggcggagggaccaagctgacgtcctgcgtcagcccaaggctgccccctcggtcactctgttccgccctcctcgctacgtaga

SEQ ID NO: 577245 - DNA, 492 bp, Homo sapiens; identical to SEQ ID NO: 566790
  misc_feature: HIJSMM301AEJVZ.52.82.H05.1.454.light.4.raw

SEQ ID NO: 577246 - DNA, 494 bp, Homo sapiens; identical to SEQ ID NO: 534994
  misc_feature: HIJSMM301B5GBC.27.78.H01.1.454.light.4.raw

SEQ ID NO: 577247 - DNA, 498 bp, Homo sapiens
  misc_feature: HIJSMM301DIBR4.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaatcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccaccctcctccacgagagta

SEQ ID NO: 577248 - DNA, 494 bp, Homo sapiens; identical to SEQ ID NO: 535276
  misc_feature: HIJSMM301D355Z.16.6.A06.1.454.light.4.raw

SEQ ID NO: 577249 - DNA, 516 bp, Homo sapiens
  misc_feature: HIJSMM301DHVJD.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctcaaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctcgttcccaccctcctcg

SEQ ID NO: 577250 - DNA, 496 bp, Homo sapiens
  misc_feature: HIJSMM301CEQEC.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttctaagttcctttttgtcttcggaactgggaccgaggtcaccgtcctaggtcagcccaaggccaaccc

SEQ ID NO: 577251 - DNA, 498 bp, Homo sapiens
  misc_feature: HIJSMM301BZ4FD.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctcatttactgggcgtctacccgggaatccggggtccctgaccgattcagtggcaggcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 577252 - DNA, 516 bp, Homo sapiens; identical to SEQ ID NO: 548316
  misc_feature: HIJSMM301BL81V.41.55.E11.1.454.light.4.raw

SEQ ID NO: 577253 - DNA, 502 bp, Homo sapiens
  misc_feature: HIJSMM301EF7OJ.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccgaggggtccaagctggagatgaaacgaactgtggctgcaccatctgtcttcatcttccccg

SEQ ID NO: 577254 - DNA, 511 bp, Homo sapiens
  misc_feature: HIJSMM301BJH3V.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagtttcactctcacaatcagcagtctcgaacctgaagattttgcaacttactactgtcaacagacttacaatataccgaggacgttcggtcaagggaccaaggtaggagatacaaacgaactacgtggctgcaccactctgtcttcatcttcccgtccact

SEQ ID NO: 577255 - DNA, 486 bp, Homo sapiens
  misc_feature: HIJSMM301DYJ6X.15.28.C06.1.454.light.4.raw
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcattttcggcggagggaccaaggtggagatcaaacgaactgtggctgcaccatctgtcttcatt

SEQ ID NO: 577256 - DNA, 484 bp, Homo sapiens
  misc_feature: HIJSMM301CPVB2.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattgatcatctatcaagatgtgaagcggccctcaggggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcaccgtctgagtcagcccaagg

SEQ ID NO: 577257 - DNA, 504 bp, Homo sapiens
  misc_feature: HIJSMM301CCV34.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggccaggctgaccgtcctgagtcagcccaaggctgtccccccg

SEQ ID NO: 577258 - DNA, 491 bp, Homo sapiens
  misc_feature: HIJSMM301AXH0R.3.77.G11.1.454.light.4.raw
  modified_base (482)..(482): a, c, t, g, unknown or other
agacgcactccacgaccggtgctcgatttagctagtcactcaagggaaagggggaggaactgctcagttaggacccagacggaaccatggaagccccagcgcagcttctcttcctccgtgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggactcctcactctatgatgtgtcttctcgggtcactggtctcccaggcaggttcagtggcagtggatctgggacagaatttcacgctcaccatcatcaggctgcggtctgacgacttcgcagtctatttctgtcaacagtacgatggccggcctccgtggacattcgggccaaggtaccaaggtggacatcagcgaactgnggctgcacc

SEQ ID NO: 577259 - DNA, 518 bp, Homo sapiens
  misc_feature: HIJSMM301D2MSU.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggcgactattactgtcaggtgtggaatggtgattatgattatgtcttcggaactgggaccaaggtcaccgtcctaggtcagcccaaggccaaccccacctgtcactctcgttcccaccctcctccgtgt

SEQ ID NO: 577260 - DNA, 489 bp, Homo sapiens; identical to SEQ ID NO: 540006
  misc_feature: HIJSMM301C7VX3.11.12.B01.1.454.light.4.raw

SEQ ID NO: 577261 - DNA, 447 bp, Homo sapiens; identical to SEQ ID NO: 535020
  misc_feature: HIJSMM301BDNII.18.9.A09.1.454.light.4.raw

SEQ ID NO: 577262 - DNA, 448 bp, Homo sapiens; identical to SEQ ID NO: 540364
  misc_feature: HIJSMM301AOY7X.18.9.A09.1.454.light.4.raw

SEQ ID NO: 577263 - DNA, 491 bp, Homo sapiens
  misc_feature: HIJSMM301D0WJS.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccacccactgtca

SEQ ID NO: 577264 - DNA, 447 bp, Homo sapiens
  misc_feature: HIJSMM301B1Y9A.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttccccgccctcctccatactcga

SEQ ID NO: 577265 - DNA, 520 bp, Homo sapiens; identical to SEQ ID NO: 537173
  misc_feature: HIJSMM301DGAGG.27.23.C01.1.454.light.4.raw

SEQ ID NO: 577266 - DNA, 505 bp, Homo sapiens; identical to SEQ ID NO: 566085
  misc_feature: HIJSMM301C7D3J.19.78.H01.1.454.light.4.raw

SEQ ID NO: 577267 - DNA, 510 bp, Homo sapiens
  misc_feature: HIJSMM301BV6YN.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgagaccgactattactgtcaggtgtgggatagtagtggtgatcatccatacgtcttcggaactgggaccaaggtctccgtcctacgtcagcccaaggccaaccccactgtcactctgttcccta

SEQ ID NO: 577268 - DNA, 509 bp, Homo sapiens; identical to SEQ ID NO: 547302
  misc_feature: HIJSMM301A31JG.4.57.F02.1.454.light.4.raw

SEQ ID NO: 577269 - DNA, 479 bp, Homo sapiens
  misc_feature: HIJSMM301CN4JN.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggtccaaggaccaaggtggaaatacaaacgaactagtggctgca

SEQ ID NO: 577270 - DNA, 487 bp, Homo sapiens; identical to SEQ ID NO: 536206
  misc_feature: HIJSMM301DOSS6.47.38.D05.1.454.light.4.raw

SEQ ID NO: 577271 - DNA, 507 bp, Homo sapiens; identical to SEQ ID NO: 549725
  misc_feature: HIJSMM301AFB1G.18.78.H01.1.454.light.4.raw

SEQ ID NO: 577272 - DNA, 484 bp, Homo sapiens; identical to SEQ ID NO: 535240
  misc_feature: HIJSMM301BJGYZ.47.60.F05.1.454.light.4.raw

SEQ ID NO: 577273 - DNA, 503 bp, Homo sapiens
  misc_feature: HIJSMM301ESHDH.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatacgtcctcctctcacgttcggcggagggaccaaggtggagatacaaacgaactgtggctgcaccatctgtctt

SEQ ID NO: 577274 - DNA, 505 bp, Homo sapiens; identical to SEQ ID NO: 537876
  misc_feature: HIJSMM301BGM4Y.5.68.G02.1.454.light.4.raw

SEQ ID NO: 577275 - DNA, 482 bp, Homo sapiens
  misc_feature: HIJSMM301A1RRP.13.5.A05.1.454.light.4.raw
tcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaaatggatatacctatttggattggtatctgcagaagccagggcagtctccacaactcctgatctattggggttctaatcgggcctccggggtccctgacaggttcagtggcagtggataaggcacagattttacactgaaaatcagcagagtggaggctgaggatgttggggtttattactgcatgcaagctctacaaactctgcggactttcggccctgggaccgaaagtaggagagtcaaacgaa

SEQ ID NO: 577276 - DNA, 483 bp, Homo sapiens
  misc_feature: HIJSMM301EHZGW.48.5.A05.1.454.light.4.raw
  modified_base (360)..(360): a, c, t, g, unknown or other
agtatacatacacgaccggtgctcgatttagatagatagacaggggggagtcagacccacgtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaacgcccctaaactcctgatctatacggcatctactttacagagtggggtcccatcaaggttcagcggcagtgcatctgggacagaattcactctcnccatcagcagcctgcagcctgatgattttgcaacttattactgccaacagtattatacttatccatggacgttcgcaacggacacgtaggaatacaaacgaactgtggcgtgcaccatcttcg

SEQ ID NO: 577277 - DNA, 504 bp, Homo sapiens
  misc_feature: HIJSMM301DCVZI.21.81.H04.1.454.light.4.raw
tcgtcgctcgcacgaccggtgctcgatttagtagtgtagattcgcggggggggtctcaggaggcagcgctctcgggacggtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggacgtgggaccaagatcaccgtcctaggtcagcccaaggccaaccccactgtca

SEQ ID NO: 577278 - DNA, 496 bp, Homo sapiens; identical to SEQ ID NO: 538149
  misc_feature: HIJSMM301D82P8.13.67.G01.1.454.light.4.raw

SEQ ID NO: 577279 - DNA, 454 bp, Homo sapiens; identical to SEQ ID NO: 534964
  misc_feature: HIJSMM301A15DQ.19.86.H09.1.454.light.4.raw

SEQ ID NO: 577280 - DNA, 496 bp, Homo sapiens; identical to SEQ ID NO: 536248
  misc_feature: HIJSMM301CJ2K1.22.27.C05.1.454.light.4.raw

SEQ ID NO: 577281 - DNA, 484 bp, Homo sapiens
  misc_feature: HIJSMM301B0RD3.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcaacagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactgtggctgcacc

SEQ ID NO: 577282 - DNA, 481 bp, Homo sapiens; identical to SEQ ID NO: 535993
  misc_feature: HIJSMM301AN4C0.21.25.C03.1.454.light.4.raw

SEQ ID NO: 577283 - DNA, 514 bp, Homo sapiens
  misc_feature: HIJSMM301DIKQY.52.15.B04.1.454.light.4.raw
cgcagtacgacacgaccggtgctcgatttagacagtatatatccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacttgggtgttcggcggcgggaccaaactgaccgtccttcgtcagcccaaggctgccccctcgtcactctgttccccg

SEQ ID NO: 577284 - DNA, 514 bp, Homo sapiens; identical to SEQ ID NO: 550589
  misc_feature: HIJSMM301C6PET.16.66.F11.1.454.light.4.raw

SEQ ID NO: 577285 - DNA, 502 bp, Homo sapiens
  misc_feature: HIJSMM301C91R1.9.71.G05.1.454.light.4.raw
tgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccaccctcctcagacgtatcac

SEQ ID NO: 577286 - DNA, 505 bp, Homo sapiens; identical to SEQ ID NO: 535503
  misc_feature: HIJSMM301AFXHI.8.28.C06.1.454.light.4.raw

SEQ ID NO: 577287 - DNA, 495 bp, Homo sapiens
  misc_feature: HIJSMM301AWR9I.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcagtgcgtct

SEQ ID NO: 577288 - DNA, 490 bp, Homo sapiens; identical to SEQ ID NO: 535234
  misc_feature: HIJSMM301E1ILD.17.21.B10.1.454.light.4.raw

SEQ ID NO: 577289 - DNA, 474 bp, Homo sapiens
  misc_feature: HIJSMM301DZPVK.9.15.B04.1.454.light.4.raw
tgatacgtctcacgaccggtgctcgatttagacagtatatatccgcgggggggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagagggtcaccatctcctgttctgggagcagctccaacatcgggggagactctgatgcacattggtatcagcagcttccagaagcagcccccaaactcctcatctatgctaacaccaatcggccctcaggggtccctgaccgattctctggctccaagtctggcacctcagccctccctgaccatcagtgaattgcagactgaggatgaggctaactactactgccagtccctccgacagcagcctgggtgtttgggtgttcggcgga

SEQ ID NO: 577290 - DNA, 512 bp, Homo sapiens
  misc_feature: HIJSMM301CHJXQ.17.33.C11.1.454.light.4.raw
cgtagactagcacgaccggtgctcgatttagagtgagctcgttgggtttggggggcgccagggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctgactattactgcctactctacttggtggtgctgtgctattcggcggagggaccaagctgaccgtcttaagtcagcccaaggctgccccctcggtcactctgttcccacctcct

SEQ ID NO: 577291 - DNA, 523 bp, Homo sapiens
  misc_feature: HIJSMM301AIX2W.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggcccgtcgggaccaaacgtaggatatacgaaacgaactggtggcgtcgccaccactcgtcgttccttcta

SEQ ID NO: 577292 - DNA, 477 bp, Homo sapiens
  misc_feature: HIJSMM301A7HFJ.51.28.C06.1.454.light.4.raw
cgatcgtatacacgaccggtgctcgatttagagctcacgtattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttactttcaccatcagcaggctgcagcctgaagacattgcaacatattactgtcaacagtatgatagtcctccgctcactttcggcgggggaccgaaggtggagatcaagacgaactgtgg

SEQ ID NO: 577293 - DNA, 502 bp, Homo sapiens
  misc_feature: HIJSMM301DG5KG.10.79.H02.1.454.light.4.raw
catagtagtgcacgaccggtgctcgatttagtgtcacacgaaggggaaagggggaagagctgctcagttaggacccaaagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcaccgtgggtacttttggccgagggaccaagctggagatacaaacgaactgtggctgcaccatctgtcttcta

SEQ ID NO: 577294 - DNA, 513 bp, Homo sapiens
  misc_feature: HIJSMM301AGDDY.10.71.G05.1.454.light.4.raw
catagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaatagaggtcaaacgaactagtggctgcaccactctcgtcttctatcttccccg

SEQ ID NO: 577295 - DNA, 500 bp, Homo sapiens
  misc_feature: HIJSMM301C8GX0.40.4.A04.1.454.light.4.raw
tctagcgactcacgaccggtgctcgatttagagtagtgatcagggggagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttactctcaccatcaccagccttcaggctgaagatgtggcagtttattactgtcaccaatatttagacattcctccgacgttcggccaagggaccaaggtggagatcaaaacgaactagtggcgtgcaccaatct

SEQ ID NO: 577296 - DNA, 492 bp, Homo sapiens
  misc_feature: HIJSMM301C6YZJ.53.22.B11.1.454.light.4.raw
cgcgtatacacacgaccggtgctcgatttagacgacagctcagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaaccccactgtcactctcg

SEQ ID NO: 577297 - DNA, 500 bp, Homo sapiens
  misc_feature: HIJSMM301CFAJW.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaaggctgaccgtctaggtcagccaaggctgccccctc

SEQ ID NO: 577298 - DNA, 522 bp, Homo sapiens
  misc_feature: HIJSMM301EDJMM.17.42.D09.1.454.light.4.raw
cgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctcgttcccaccct

SEQ ID NO: 577299 - DNA, 485 bp, Homo sapiens
  misc_feature: HIJSMM301BA4D1.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcagggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 577300 - DNA, 500 bp, Homo sapiens; identical to SEQ ID NO: 542309
  misc_feature: HIJSMM301ESZLI.12.86.H09.1.454.light.4.raw

SEQ ID NO: 577301 - DNA, 462 bp, Homo sapiens
  misc_feature: HIJSMM301AZPOD.49.75.G09.1.454.light.4.raw
agtcgagagacacgaccggtgctcgatttagtatagacatcagggggagtcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatccagcgaa

SEQ ID NO: 577302 - DNA, 498 bp, Homo sapiens
  misc_feature: HIJSMM301C4KTE.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgattttcggcggagggaccaagttgaccgtcctaggtcagcccaaggctgccccctcggtcactcttccg

SEQ ID NO: 577303 - DNA, 483 bp, Homo sapiens
  misc_feature: HIJSMM301AK7D1.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtgacgtggccaagggaccaaggtggatatcagacgaa

SEQ ID NO: 577304 - DNA, 447 bp, Homo sapiens; identical to SEQ ID NO: 535201
  misc_feature: HIJSMM301BHEP9.18.9.A09.1.454.light.4.raw

SEQ ID NO: 577305 - DNA, 495 bp, Homo sapiens
  misc_feature: HIJSMM301B1P9H.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaaactgtggctgcaccat

SEQ ID NO: 577306 - DNA, 483 bp, Homo sapiens
  misc_feature: HIJSMM301D30B7.40.83.H06.1.454.light.4.raw
  modified_base (441)..(441): a, c, t, g, unknown or other
tctagcgactcacgaccggtgctcgatttagatcacgtgcgtcgcgggaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggngttcggcggagggaccaaactgtccgtcctaggtcagcccaa

SEQ ID NO: 577307 - DNA, 489 bp, Homo sapiens
  misc_feature: HIJSMM301ETZ5L.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtctttca

SEQ ID NO: 577308 - DNA, 495 bp, Homo sapiens; identical to SEQ ID NO: 539489
  misc_feature: HIJSMM301A0K8K.51.59.F04.1.454.light.4.raw

SEQ ID NO: 577309 - DNA, 499 bp, Homo sapiens
  misc_feature: HIJSMM301DAU6H.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaacccactg

SEQ ID NO: 577310 - DNA, 497 bp, Homo sapiens
  misc_feature: HIJSMM301AYVL6.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctccgagtgcgtct

SEQ ID NO: 577311 - DNA, 487 bp, Homo sapiens; identical to SEQ ID NO: 544897
  misc_feature: HIJSMM301AK8HY.46.35.D02.1.454.light.4.raw

SEQ ID NO: 577312 - DNA, 496 bp, Homo sapiens; identical to SEQ ID NO: 538149
  misc_feature: HIJSMM301EETXM.13.67.G01.1.454.light.4.raw

SEQ ID NO: 577313 - DNA, 477 bp, Homo sapiens
  misc_feature: HIJSMM301DB773.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgagacgaggctgactattactgctcagcatgggacagcagcctccgtggtgtggtgatcggcggagggaccgaggctcgaccgtcct

SEQ ID NO: 577314 - DNA, 476 bp, Homo sapiens
  misc_feature: HIJSMM301A51V3.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggccaggggaccaagctggagaggaaacgaactgtggctgcacat

SEQ ID NO: 577315 - DNA, 519 bp, Homo sapiens
  misc_feature: HIJSMM301ATF2L.14.78.H01.1.454.light.4.raw
cgtctagtaccacgaccggtgctcgatttagtgtgagtagtttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgttccccg

SEQ ID NO: 577316 - DNA, 488 bp, Homo sapiens
  misc_feature: HIJSMM301A0LQD.43.53.E09.1.454.light.4.raw
  modified_base (364)..(364): a, c, t, g, unknown or other
tgtgagtagtcacgaccggtgctcgatttagagagagtgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttcnctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 577317 - DNA, 484 bp, Homo sapiens
  misc_feature: HIJSMM301CL5KZ.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagcccaccctccatgtccgtgtccccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcaggacccaggctattgatgaggctgactattattgtcaggcgtgggacagcagcactgcccgttatgtcttcggaactgggaccaaggtcaccgt

SEQ ID NO: 577318 - DNA, 491 bp, Homo sapiens
  misc_feature: HIJSMM301C2TYE.52.82.H05.1.454.light.4.raw
cgcagtacgacacgaccggtgctcgatttagtcgagctctctcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgt

SEQ ID NO: 577319 - DNA, 517 bp, Homo sapiens
  misc_feature: HIJSMM301AXB98.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggaccgaaggtaggaagtacgaaacgaaacctagtaggcgtgcgaccactctcgtcttctatcttcccgtccact

SEQ ID NO: 577320 - DNA, 499 bp, Homo sapiens; identical to SEQ ID NO: 545768
  misc_feature: HIJSMM301ECNQH.52.36.D03.1.454.light.4.raw

SEQ ID NO: 577321 - DNA, 445 bp, Homo sapiens
  misc_feature: HIJSMM301DQLEH.14.76.G10.1.454.light.4.raw
  modified_base (427)..(427): a, c, t, g, unknown or other
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttccccnccctcctcgtactagacg

SEQ ID NO: 577322 - DNA, 493 bp, Homo sapiens; identical to SEQ ID NO: 549048
  misc_feature: HIJSMM301EYUWM.16.86.H09.1.454.light.4.raw

SEQ ID NO: 577323 - DNA, 515 bp, Homo sapiens
  misc_feature: HIJSMM301AZ6WC.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaacgggaccgaacggtaggaaagtacaaacgaaaccgtagtggcgtcgcgacctaa

SEQ ID NO: 577324 - DNA, 480 bp, Homo sapiens
  misc_feature: HIJSMM301DCOCG.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtctaggtcagcccaaggctgccccccg

SEQ ID NO: 577325 - DNA, 480 bp, Homo sapiens; identical to SEQ ID NO: 570636
  misc_feature: HIJSMM301BRB9V.16.86.H09.1.454.light.4.raw

SEQ ID NO: 577326 - DNA, 484 bp, Homo sapiens; identical to SEQ ID NO: 535400
  misc_feature: HIJSMM301BFBXD.46.26.C04.1.454.light.4.raw

SEQ ID NO: 577327 - DNA, 482 bp, Homo sapiens
  misc_feature: HIJSMM301B5V2T.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtgcccgctcattttcggcggagggaccaaggtgcagatcaacgaactgtggctgca

SEQ ID NO: 577328 - DNA, 493 bp, Homo sapiens
  misc_feature: HIJSMM301AZXAD.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtcgtgggacagatttcactctcaccatcagcagcctgcaggctgaagatgtggctagtttattactgtcaacatattataataatcctatttaattcggcggaggaccgaaggtggagatacaaacgaactgtggctgcacatctgtcttcatccttcccgcta

SEQ ID NO: 577329 - DNA, 504 bp, Homo sapiens; identical to SEQ ID NO: 550837
  misc_feature: HIJSMM301EZX4S.48.57.F02.1.454.light.4.raw

SEQ ID NO: 577330 - DNA, 498 bp, Homo sapiens
  misc_feature: HIJSMM301BQGS8.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattctcctcagacgtggtccgacggacgaacgtaggaagtagaaacaaacaagtagcgtgcaca

SEQ ID NO: 577331 - DNA, 518 bp, Homo sapiens
  misc_feature: HIJSMM301EOIOL.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcacccttcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggcctgccccctcggtcactctgttccca

SEQ ID NO: 577332 - DNA, 504 bp, Homo sapiens
  misc_feature: HIJSMM301CZRGM.9.53.E09.1.454.light.4.raw
  modified_base (444)..(444): a, c, t, g, unknown or other
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccagtctgacgacgaggctgattattactgcagctcatatgcagtgtcgtcttcaanctagttcgtcggaggacgacgacgtgaccgtcctggactagaccgaccgacgcgtccccg

SEQ ID NO: 577333 - DNA, 506 bp, Homo sapiens
  misc_feature: HIJSMM301C6IRA.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttattctgtcagcagtctgaagactggccgttcactttcggcggagggaccaaggtggacctcaaacgactgtggctgcaccatctgtcttcactcttcccgcact

SEQ ID NO: 577334 - DNA, 492 bp, Homo sapiens
  misc_feature: HIJSMM301A3HVK.4.34.D01.1.454.light.4.raw
agcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttataaagagttcggcggagggaccaagctgaccgtcctaggtcagcccaaggctgccccccg

SEQ ID NO: 577335 - DNA, 498 bp, Homo sapiens
  misc_feature: HIJSMM301DBUH9.48.59.F04.1.454.light.4.raw
agtatacatacacgaccggtgctcgatttagtacacacacttagggattggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtattcat

SEQ ID NO: 577336 - DNA, 484 bp, Homo sapiens; identical to SEQ ID NO: 535211
  misc_feature: HIJSMM301CH4OZ.47.46.E02.1.454.light.4.raw

SEQ ID NO: 577337 - DNA, 494 bp, Homo sapiens; identical to SEQ ID NO: 534992
  misc_feature: HIJSMM301BLWWM.9.1.A01.1.454.light.4.raw

SEQ ID NO: 577338 - DNA, 509 bp, Homo sapiens
  misc_feature: HIJSMM301A54BE.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcaggacacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgtt

SEQ ID NO: 577339 - DNA, 502 bp, Homo sapiens; identical to SEQ ID NO: 537363
  misc_feature: HIJSMM301EJNRV.18.23.C01.1.454.light.4.raw

SEQ ID NO: 577340 - DNA, 463 bp, Homo sapiens; identical to SEQ ID NO: 535062
  misc_feature: HIJSMM301EMNW3.11.73.G07.1.454.light.4.raw

SEQ ID NO: 577341 - DNA, 486 bp, Homo sapiens
  misc_feature: HIJSMM301B8URQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaagtgggatatcagacgaa

SEQ ID NO: 577342 - DNA, 447 bp, Homo sapiens; identical to SEQ ID NO: 535020
  misc_feature: HIJSMM301EEBPJ.18.9.A09.1.454.light.4.raw

SEQ ID NO: 577343 - DNA, 509 bp, Homo sapiens
  misc_feature: HIJSMM301CH9R5.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcactatttttcttggtttttggcgggcgggacccagatgactgtcctcagtcagcccaaggctcgccccctcggt

SEQ ID NO: 577344 - DNA, 458 bp, Homo sapiens
  misc_feature: HIJSMM301B9MI2.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcagcccaaggctgccccctcggtcactctgttccccgccctcctcatagtataga

SEQ ID NO: 577345 - DNA, 497 bp, Homo sapiens
  misc_feature: HIJSMM301EUGNO.53.38.D05.1.454.light.4.raw
cgcgtatacacacgaccggtgctcgatttagtatctgatagttgggtttgggggggaggcctagctgtgctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccc

SEQ ID NO: 577346 - DNA, 478 bp, Homo sapiens
  misc_feature: HIJSMM301DDBAY.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaagtttcagtggcagtgggtctgggacagatttcactctcaccatcagcagtctgcaacctgaagattctgcaacttattactgtcaacagagtaacagttaccctcccacttttcggcggagggaccaaggtggagatcaaacgaactgtggctgca

SEQ ID NO: 577347 - DNA, 389 bp, Homo sapiens; identical to SEQ ID NO: 558170
  misc_feature: HIJSMM301D388U.21.40.D07.1.454.light.4.raw

SEQ ID NO: 577348 - DNA, 485 bp, Homo sapiens; identical to SEQ ID NO: 535822
  misc_feature: HIJSMM301A89WB.14.53.E09.1.454.light.4.raw

SEQ ID NO: 577349 - DNA, 484 bp, Homo sapiens
  misc_feature: HIJSMM301CO5CO.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttatactgtcaacagtataatgactggtggacgttcggccaagggaccaaggtggagaccaaacgaactgtggctgcaccat

SEQ ID NO: 577350 - DNA, 504 bp, Homo sapiens
  misc_feature: HIJSMM301B9OQL.40.67.G01.1.454.light.4.raw
tctagcgactcacgaccggtgctcgatttagagtatacatattgggtttgggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggccccctcacgttcggcggagggaccaaggtggacatcaaacgactgtggctgcaccatctgtcttcatcttcccgccat

SEQ ID NO: 577351 - DNA, 489 bp, Homo sapiens; identical to SEQ ID NO: 558406
  misc_feature: HIJSMM301AI2K5.19.15.B04.1.454.light.4.raw

SEQ ID NO: 577352 - DNA, 509 bp, Homo sapiens; identical to SEQ ID NO: 536363
  misc_feature: HIJSMM301CTUHJ.17.33.C11.1.454.light.4.raw

SEQ ID NO: 577353 - DNA, 503 bp, Homo sapiens
  misc_feature: HIJSMM301CKE5E.10.29.C07.1.454.light.4.raw
catagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcgagggaccaagctgaccgtctaggtcagcccaaggctgccccctcggtca

SEQ ID NO: 577354 - DNA, 489 bp, Homo sapiens; identical to SEQ ID NO: 535139
  misc_feature: HIJSMM301EAVCP.14.55.E11.1.454.light.4.raw

SEQ ID NO: 577355 - DNA, 507 bp, Homo sapiens; identical to SEQ ID NO: 538063
  misc_feature: HIJSMM301D625E.47.85.H08.1.454.light.4.raw

SEQ ID NO: 577356 - DNA, 503 bp, Homo sapiens
  misc_feature: HIJSMM301BJSFH.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaacccca

SEQ ID NO: 577357 - DNA, 512 bp, Homo sapiens; identical to SEQ ID NO: 548495
  misc_feature: HIJSMM301D5MTT.48.34.D01.1.454.light.4.raw

SEQ ID NO: 577358 - DNA, 502 bp, Homo sapiens; identical to SEQ ID NO: 542554
  misc_feature: HIJSMM301DRB83.48.67.G01.1.454.light.4.raw

SEQ ID NO: 577359 - DNA, 507 bp, Homo sapiens
  misc_feature: HIJSMM301E4G83.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccgaaggtggagatcaagcgaactgtggctgcaccatctgtcttcatcttcccgcc

SEQ ID NO: 577360 - DNA, 484 bp, Homo sapiens; identical to SEQ ID NO: 466217
  misc_feature: HIJSMM301EBS3B.15.1.A01.1.454.light.4.raw

SEQ ID NO: 577361 - DNA, 500 bp, Homo sapiens
  misc_feature: HIJSMM301BR2OR.41.18.B07.1.454.light.4.raw
tctatactatcacgaccggtgctcgatttagtcgctgcgtaaggggggtggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaagctgaccgtcctaggtcagcccaaggctgccccctcggtcactctcg

SEQ ID NO: 577362 - DNA, 508 bp, Homo sapiens; identical to SEQ ID NO: 535835
  misc_feature: HIJSMM301BX9OW.8.34.D01.1.454.light.4.raw

SEQ ID NO: 577363 - DNA, 489 bp, Homo sapiens
  misc_feature: HIJSMM301AYH6S.43.6.A06.1.454.light.4.raw
tgtgagtagtcacgaccggtgctcgatttagatctactgacagggcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggt

SEQ ID NO: 577364 - DNA, 507 bp, Homo sapiens
  misc_feature: HIJSMM301ADMVP.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaggccaccccactgtcactctgttccca

SEQ ID NO: 577365 - DNA, 504 bp, Homo sapiens; identical to SEQ ID NO: 535561
  misc_feature: HIJSMM301ECCED.4.57.F02.1.454.light.4.raw

SEQ ID NO: 577366 - DNA, 478 bp, Homo sapiens
  misc_feature: HIJSMM301BPL3M.48.75.G09.1.454.light.4.raw
agtatacatacacgaccggtgctcgatttagtatagacatcaggggactgatcaggacttctcagttcatctcctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaagaa

SEQ ID NO: 577367 - DNA, 496 bp, Homo sapiens; identical to SEQ ID NO: 541772
  misc_feature: HIJSMM301ENEMZ.51.81.H04.1.454.light.4.raw

SEQ ID NO: 577368 - DNA, 511 bp, Homo sapiens
  misc_feature: HIJSMM301BWNU3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgtccaggaccgaacggtggaagtcaaacgaactagtggcgtgcaccactctgtcttctactcttcccgtccact

SEQ ID NO: 577369 - DNA, 444 bp, Homo sapiens; identical to SEQ ID NO: 535411
  misc_feature: HIJSMM301B1G0F.8.73.G07.1.454.light.4.raw

SEQ ID NO: 577370 - DNA, 493 bp, Homo sapiens; identical to SEQ ID NO: 543949
  misc_feature: HIJSMM301ASWYW.16.68.G02.1.454.light.4.raw

SEQ ID NO: 577371 - DNA, 504 bp, Homo sapiens; identical to SEQ ID NO: 540538
  misc_feature: HIJSMM301EGE7P.7.71.G05.1.454.light.4.raw

SEQ ID NO: 577372 - DNA, 463 bp, Homo sapiens
  misc_feature: HIJSMM301D3DA0.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttatactgtcagcagcgtagcaactggcctctcactttcggcggagggaccagggtggagatcagacgaactgtggctgcaccatctgtcttcatcttcccgccatctgaagtatagtct

SEQ ID NO: 577373 - DNA, 502 bp, Homo sapiens; identical to SEQ ID NO: 536253
  misc_feature: HIJSMM301CJ37L.21.22.B11.1.454.light.4.raw

SEQ ID NO: 577374 - DNA, 498 bp, Homo sapiens; identical to SEQ ID NO: 535974
  misc_feature: HIJSMM301CQNX8.22.27.C05.1.454.light.4.raw

SEQ ID NO: 577375 - DNA, 509 bp, Homo sapiens; identical to SEQ ID NO: 557518
  misc_feature: HIJSMM301AZNA2.8.34.D01.1.454.light.4.raw

SEQ ID NO: 577376 - DNA, 521 bp, Homo sapiens
  misc_feature: HIJSMM301BHZ0X.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaactggttgcaccgcaaagcggggacccagaccctggagcctcagttggaagcagccgatccagcctgcggagcctgtggggcaggtcagcccaaggccaacccccactcgtcactctcg

SEQ ID NO: 577377 - DNA, 476 bp, Homo sapiens
  misc_feature: HIJSMM301DI8XY.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaactaactgtggctgca

SEQ ID NO: 577378 - DNA, 494 bp, Homo sapiens; identical to SEQ ID NO: 534992
  misc_feature: HIJSMM301CJ8TW.9.1.A01.1.454.light.4.raw

SEQ ID NO: 577379 - DNA, 484 bp, Homo sapiens; identical to SEQ ID NO: 535400
  misc_feature: HIJSMM301EAW4A.46.26.C04.1.454.light.4.raw

SEQ ID NO: 577380 - DNA, 497 bp, Homo sapiens; identical to SEQ ID NO: 536376
  misc_feature: HIJSMM301DSW0D.22.9.A09.1.454.light.4.raw

SEQ ID NO: 577381 - DNA, 495 bp, Homo sapiens; identical to SEQ ID NO: 541961
  misc_feature: HIJSMM301A7QSU.21.27.C05.1.454.light.4.raw
  modified_base (198)..(198): a, c, t, g, unknown or other

SEQ ID NO: 577382 - DNA, 504 bp, Homo sapiens; identical to SEQ ID NO: 543173
  misc_feature: HIJSMM301EA6PJ.41.35.D02.1.454.light.4.raw

SEQ ID NO: 577383 - DNA, 484 bp, Homo sapiens; identical to SEQ ID NO: 569020
  misc_feature: HIJSMM301A0HOV.40.83.H06.1.454.light.4.raw

SEQ ID NO: 577384 - DNA, 495 bp, Homo sapiens
  misc_feature: HIJSMM301BJZSU.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatacaaacgaactggtggctgcaccatctgtctcatcttcccgc

SEQ ID NO: 577385 - DNA, 489 bp, Homo sapiens; identical to SEQ ID NO: 535139
  misc_feature: HIJSMM301COY57.14.55.E11.1.454.light.4.raw

SEQ ID NO: 577386 - DNA, 498 bp, Homo sapiens; identical to SEQ ID NO: 541355
  misc_feature: HIJSMM301CBA4B.12.87.H10.1.454.light.4.raw

SEQ ID NO: 577387 - DNA, 491 bp, Homo sapiens; identical to SEQ ID NO: 535176
  misc_feature: HIJSMM301APOM7.13.39.D06.1.454.light.4.raw

SEQ ID NO: 577388 - DNA, 482 bp, Homo sapiens; identical to SEQ ID NO: 540521
  misc_feature: HIJSMM301AJF1Y.21.25.C03.1.454.light.4.raw

SEQ ID NO: 577389 - DNA, 499 bp, Homo sapiens; identical to SEQ ID NO: 538774
  misc_feature: HIJSMM301AKJMZ.26.26.C04.1.454.light.4.raw

SEQ ID NO: 577390 - DNA, 478 bp, Homo sapiens
  misc_feature: HIJSMM301BWPL0.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttactttgtcaacaggctcagagtttcccgcttcactttcggcggagggaccaaggtggagatcaacgaactgtggctgca

SEQ ID NO: 577391 - DNA, 486 bp, Homo sapiens
  misc_feature: HIJSMM301ARQOV.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactctgttcccgccctcctcgctacgtaga

SEQ ID NO: 577392 - DNA, 503 bp, Homo sapiens
  misc_feature: HIJSMM301AGCYD.19.67.G01.1.454.light.4.raw
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctgggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctc

SEQ ID NO: 577393 - DNA, 441 bp, Homo sapiens; identical to SEQ ID NO: 534971
  misc_feature: HIJSMM301ECKJG.11.3.A03.1.454.light.4.raw

SEQ ID NO: 577394 - DNA, 501 bp, Homo sapiens; identical to SEQ ID NO: 537262
  misc_feature: HIJSMM301AUAOO.8.55.E11.1.454.light.4.raw

SEQ ID NO: 577395 - DNA, 508 bp, Homo sapiens; identical to SEQ ID NO: 538771
  misc_feature: HIJSMM301CZUFC.8.33.C11.1.454.light.4.raw

SEQ ID NO: 577396 - DNA, 488 bp, Homo sapiens; identical to SEQ ID NO: 535081
  misc_feature: HIJSMM301A1I5A.26.23.C01.1.454.light.4.raw

SEQ ID NO: 577397 - DNA, 484 bp, Homo sapiens; identical to SEQ ID NO: 535400
  misc_feature: HIJSMM301D0E2C.46.26.C04.1.454.light.4.raw

SEQ ID NO: 577398 - DNA, 495 bp, Homo sapiens; identical to SEQ ID NO: 576393
  misc_feature: HIJSMM301A3K8G.11.81.H04.1.454.light.4.raw

SEQ ID NO: 577399 - DNA, 496 bp, Homo sapiens
  misc_feature: HIJSMM301D5NDS.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggaggaccaagctgaccgtcctaggtcagcccaaggctgccccctcggt

SEQ ID NO: 577400 - DNA, 482 bp, Homo sapiens
  misc_feature: HIJSMM301APOTN.4.1.A01.1.454.light.4.raw
agcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaagaactgtggctgcaccatctgtcttca

SEQ ID NO: 577401 - DNA, 417 bp, Homo sapiens
  misc_feature: HIJSMM301AIHR5.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctcgttcccgccctcctccatactcgta

SEQ ID NO: 577402 - DNA, 518 bp, Homo sapiens
  misc_feature: HIJSMM301BW3P7.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtccactctgttcccaccctccctccg

SEQ ID NO: 577403 - DNA, 488 bp, Homo sapiens; identical to SEQ ID NO: 535725
  misc_feature: HIJSMM301DR10Z.12.88.H11.1.454.light.4.raw

SEQ ID NO: 577404 - DNA, 514 bp, Homo sapiens
  misc_feature: HIJSMM301DINM2.48.34.D01.1.454.light.4.raw
agtatacatacacgaccggtgctcgatttagatcgtctgtgttgggtttgggggggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctcgccccctcggtcactctcgttcccacctcct

SEQ ID NO: 577405 - DNA, 496 bp, Homo sapiens
  misc_feature: HIJSMM301BD7B3.52.45.E01.1.454.light.4.raw
cgcagtacgacacgaccggtgctcgatttagtgagtcagtaagggaaagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttttgatgtacactggtaccagcagcttccgggaacagccccaaactcctcatctttggtaacagcaatcggccctccggggtccctgaccgattctctggctccaagtctggcacctcagcctccctggccatcactgggctccaggctgaggatgaggctgattattactgccagtcctatgacagcagcctgagtgtctttgggtcttcggaactgggaccaaggtcaccgtcctaggtcacg

SEQ ID NO: 577406 - DNA, 496 bp, Homo sapiens; identical to SEQ ID NO: 572828
  misc_feature: HIJSMM301D9SK1.47.64.F09.1.454.light.4.raw

SEQ ID NO: 577407 - DNA, 447 bp, Homo sapiens; identical to SEQ ID NO: 535020
  misc_feature: HIJSMM301DFV5G.18.9.A09.1.454.light.4.raw

SEQ ID NO: 577408 - DNA, 498 bp, Homo sapiens; identical to SEQ ID NO: 566871
  misc_feature: HIJSMM301DUUKD.22.86.H09.1.454.light.4.raw

SEQ ID NO: 577409 - DNA, 494 bp, Homo sapiens; identical to SEQ ID NO: 535276
  misc_feature: HIJSMM301BNT5U.16.6.A06.1.454.light.4.raw

SEQ ID NO: 577410 - DNA, 500 bp, Homo sapiens
  misc_feature: HIJSMM301B969K.21.81.H04.1.454.light.4.raw
tcgtcgctcgcacgaccggtgctcgatttagtagtgtagattcgcggggggggtctcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaatcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaaacacttatgtcttcgggactgggaccaagatcacgtcctaggtcagcccaaggccaacccatgtca

SEQ ID NO: 577411 - DNA, 454 bp, Homo sapiens; identical to SEQ ID NO: 534964
  misc_feature: HIJSMM301DJ1SO.19.86.H09.1.454.light.4.raw

SEQ ID NO: 577412 - DNA, 502 bp, Homo sapiens
  misc_feature: HIJSMM301B4LRY.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcc

SEQ ID NO: 577413 - DNA, 507 bp, Homo sapiens
  misc_feature: HIJSMM301BADSY.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccaaggtacggaagtacaagacgaacctagtggcgtgcgaccactctgtcttctatt

SEQ ID NO: 577414 - DNA, 497 bp, Homo sapiens; identical to SEQ ID NO: 536376
  misc_feature: HIJSMM301CBQGD.22.9.A09.1.454.light.4.raw

SEQ ID NO: 577415 - DNA, 489 bp, Homo sapiens; identical to SEQ ID NO: 536663
  misc_feature: HIJSMM301AL8X4.16.72.G06.1.454.light.4.raw

SEQ ID NO: 577416 - DNA, 495 bp, Homo sapiens
  misc_feature: HIJSMM301AL03R.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatctgggacagaattcactctcgccatcagcagcctgcagcctgatgattttgcaacttattactgccaacagtataatacttattcgtggacgttcggtccaagggaccaaaggtggaaagtcaaacgaaactagtggctgcaccatct

SEQ ID NO: 577417 - DNA, 502 bp, Homo sapiens; identical to SEQ ID NO: 541971
  misc_feature: HIJSMM301DC9X0.4.39.D06.1.454.light.4.raw

SEQ ID NO: 577418 - DNA, 494 bp, Homo sapiens
  misc_feature: HIJSMM301CI85H.26.11.A11.1.454.light.4.raw
agactatactcacgaccggtgctcgatttagctacgactgcgagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggagatcagacgaactgtggctgcaccatctgtcttcatcttcccg

SEQ ID NO: 577419 - DNA, 489 bp, Homo sapiens; identical to SEQ ID NO: 535386
  misc_feature: HIJSMM301C70H5.12.51.E07.1.454.light.4.raw

SEQ ID NO: 577420 - DNA, 505 bp, Homo sapiens
  misc_feature: HIJSMM301B6Q81.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggcccaagggacacgactggagattaaaacg

SEQ ID NO: 577421 - DNA, 489 bp, Homo sapiens; identical to SEQ ID NO: 539323
  misc_feature: HIJSMM301DH1HR.49.46.E02.1.454.light.4.raw

SEQ ID NO: 577422 - DNA, 504 bp, Homo sapiens
  misc_feature: HIJSMM301AQG7X.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgtcccaccctcctcctacgtcgtat

SEQ ID NO: 577423 - DNA, 485 bp, Homo sapiens; identical to SEQ ID NO: 536040
  misc_feature: HIJSMM301A0GPG.15.1.A01.1.454.light.4.raw

SEQ ID NO: 577424 - DNA, 505 bp, Homo sapiens
  misc_feature: HIJSMM301DHODA.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagttttatactgtcagcaattatttttctatcctccgtggacgttcggccaagggaccagggtggaaatcagacgaactggtgctgcaccatctgtctt

SEQ ID NO: 577425 - DNA, 518 bp, Homo sapiens; identical to SEQ ID NO: 548899
  misc_feature: HIJSMM301ELGP8.41.25.C03.1.454.light.4.raw

SEQ ID NO: 577426 - DNA, 484 bp, Homo sapiens; identical to SEQ ID NO: 537878
  misc_feature: HIJSMM301EJ47F.17.34.D01.1.454.light.4.raw

SEQ ID NO: 577427 - DNA, 513 bp, Homo sapiens
  misc_feature: HIJSMM301ADD9S.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccgaaacgtaggatatcaaacgaactagtggctgcaccatctgtcttcta

SEQ ID NO: 577428 - DNA, 513 bp, Homo sapiens
  misc_feature: HIJSMM301AEQ2Y.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccgaaggtggaagtcaagcgaactgtggctgcaccatctgtcttcatcttcccgccc

SEQ ID NO: 577429 - DNA, 530 bp, Homo sapiens
  misc_feature: HIJSMM301AVPB0.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaacctacatcatttttgtaggtcactacgcgaccctccaggggtcccgtcgatcgcttctctggctccaagtctggcaacacggcctccctgaccgtctctgggcgtccaggctgaggatgaggctgattattacttgcagctcatatgcaggcgagcagcagtccccactgtgatctttcgggcggggggaccggaacgacgtcgaccgtcccgtaggttacgacgacccgaacggacg

SEQ ID NO: 577430 - DNA, 496 bp, Homo sapiens; identical to SEQ ID NO: 553382
  misc_feature: HIJSMM301DV3LS.51.59.F04.1.454.light.4.raw

SEQ ID NO: 577431 - DNA, 486 bp, Homo sapiens; identical to SEQ ID NO: 535385
  misc_feature: HIJSMM301DAN65.19.71.G05.1.454.light.4.raw

SEQ ID NO: 577432 - DNA, 489 bp, Homo sapiens; identical to SEQ ID NO: 535139
  misc_feature: HIJSMM301AX59P.14.55.E11.1.454.light.4.raw

SEQ ID NO: 577433 - DNA, 522 bp, Homo sapiens; identical to SEQ ID NO: 541090
  misc_feature: HIJSMM301DZJP4.27.23.C01.1.454.light.4.raw

SEQ ID NO: 577434 - DNA, 494 bp, Homo sapiens; identical to SEQ ID NO: 536444
  misc_feature: HIJSMM301BLSJE.26.72.G06.1.454.light.4.raw

SEQ ID NO: 577435 - DNA, 416 bp, Homo sapiens; identical to SEQ ID NO: 535308
  misc_feature: HIJSMM301ARFB5.16.46.E02.1.454.light.4.raw

SEQ ID NO: 577436 - DNA, 495 bp, Homo sapiens; identical to SEQ ID NO: 535821
  misc_feature: HIJSMM301CI9BH.3.31.C09.1.454.light.4.raw

SEQ ID NO: 577437 - DNA, 485 bp, Homo sapiens; identical to SEQ ID NO: 536723
  misc_feature: HIJSMM301AME4H.5.40.D07.1.454.light.4.raw

SEQ ID NO: 577438 - DNA, 494 bp, Homo sapiens; identical to SEQ ID NO: 534994
  misc_feature: HIJSMM301A3KPB.27.78.H01.1.454.light.4.raw

SEQ ID NO: 577439 - DNA, 496 bp, Homo sapiens
  misc_feature: HIJSMM301AHFFX.40.81.H04.1.454.light.4.raw
tctagcgactcacgaccggtgctcgatttagtagtgtagattcgcgggcgtagactttgtgtttctcgtaggctccctgctcagctcctggggctgctaatgctctgggtctctggatccagtggggatattgtgatgactcagtctccactctccctgccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagagatgttgggatttattactgcatgcaacctctacaaactgtgtggacggtcggccaagggaccaaggtggaaatcaagcgaactgtggctgcaccatctgtcttcatcttcccg

SEQ ID NO: 577440 - DNA, 520 bp, Homo sapiens
  misc_feature: HIJSMM301A5MRO.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactttactttggtggtgctgtgctattcggcggagggaccaagctgaccgtcttaagtcagcccaaggctgccccctcggtcactctgttcccaccctcctcctacg

SEQ ID NO: 577441 - DNA, 520 bp, Homo sapiens
  misc_feature: HIJSMM301EHLN7.41.19.B08.1.454.light.4.raw
tctatactatcacgaccggtgctcgatttagtgagtcagtaaggggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttaatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttcccgccctcctcat

SEQ ID NO: 577442 - DNA, 499 bp, Homo sapiens
  misc_feature: HIJSMM301DD7JH.3.27.C05.1.454.light.4.raw
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctgaccgattcaatggcagcgggtctggggcagatttcactctcaccatcagcagcctgcaggctgaagatgtggcagtttattactgtcagcaatattatactcctcttccgacgttcgccaagggaccaaggtggaaatcaaacgaactgtggctgcaccat

SEQ ID NO: 577443 - DNA, 501 bp, Homo sapiens
  misc_feature: HIJSMM301DM27A.18.59.F04.1.454.light.4.raw
tacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccca

SEQ ID NO: 577444 - DNA, 487 bp, Homo sapiens; identical to SEQ ID NO: 537573
  misc_feature: HIJSMM301AXDSA.3.10.A10.1.454.light.4.raw

SEQ ID NO: 577445 - DNA, 518 bp, Homo sapiens; identical to SEQ ID NO: 539372
  misc_feature: HIJSMM301D3MX0.7.86.H09.1.454.light.4.raw

SEQ ID NO: 577446 - DNA, 495 bp, Homo sapiens
  misc_feature: HIJSMM301A2CUK.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcgggcggagggaccaagctgaccgtcctaggtcagcccaaggctgccccctcggtcactctgttcccaccctcctcacgcg

SEQ ID NO: 577447 - DNA, 488 bp, Homo sapiens
  misc_feature: HIJSMM301EBEP7.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaagtcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccgaaggtggagatcaaacgaact

SEQ ID NO: 577448 - DNA, 503 bp, Homo sapiens; identical to SEQ ID NO: 542390
  misc_feature: HIJSMM301BFR9C.15.25.C03.1.454.light.4.raw

SEQ ID NO: 577449 - DNA, 504 bp, Homo sapiens; identical to SEQ ID NO: 539091
  misc_feature: HIJSMM301BKU8V.8.28.C06.1.454.light.4.raw

SEQ ID NO: 577450 - DNA, 495 bp, Homo sapiens; identical to SEQ ID NO: 554198
  misc_feature: HIJSMM301ALU8G.41.53.E09.1.454.light.4.raw

SEQ ID NO: 577451 - DNA, 499 bp, Homo sapiens
  misc_feature: HIJSMM301B7F26.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttacccctcggacgttcggtccgacggggaccgacggtcggagtgtcgaagacgaacgtgtggctggcaccactcttcg

SEQ ID NO: 577452 - DNA, 528 bp, Homo sapiens
  misc_feature: HIJSMM301DLIRJ.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcgggcggaggaccgaacggtaggtaccggtacccgtaccgttaccacgacccgaaccggacgtcgtcccccgtcccggtccgacctccttccg

SEQ ID NO: 577453 - DNA, 520 bp, Homo sapiens; identical to SEQ ID NO: 535773
  misc_feature: HIJSMM301CQOL2.41.19.B08.1.454.light.4.raw

SEQ ID NO: 577454 - DNA, 514 bp, Homo sapiens; identical to SEQ ID NO: 546238
  misc_feature: HIJSMM301AYI83.47.85.H08.1.454.light.4.raw

SEQ ID NO: 577455 - DNA, 484 bp, Homo sapiens; identical to SEQ ID NO: 535400
  misc_feature: HIJSMM301BKHOZ.46.26.C04.1.454.light.4.raw

SEQ ID NO: 577456 - DNA, 489 bp, Homo sapiens
  misc_feature: HIJSMM301CNU6Y.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaagggaccgaaggtaggaaatacaaacgaactagtggctgcaccta

SEQ ID NO: 577457 - DNA, 487 bp, Homo sapiens
  misc_feature: HIJSMM301C85VC.12.31.C09.1.454.light.4.raw
  modified_base (461)..(461): a, c, t, g, unknown or other
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcgccaagggacacgaccncagattggacgaactgtggctgcacc

SEQ ID NO: 577458 - DNA, 493 bp, Homo sapiens; identical to SEQ ID NO: 537239
  misc_feature: HIJSMM301AHPWM.49.66.F11.1.454.light.4.raw

SEQ ID NO: 577459 - DNA, 506 bp, Homo sapiens; identical to SEQ ID NO: 563474
  misc_feature: HIJSMM301B4F4D.10.27.C05.1.454.light.4.raw

SEQ ID NO: 577460 - DNA, 495 bp, Homo sapiens; identical to SEQ ID NO: 538651
  misc_feature: HIJSMM301CLEF8.10.79.H02.1.454.light.4.raw

SEQ ID NO: 577461 - DNA, 492 bp, Homo sapiens
  misc_feature: HIJSMM301D68FQ.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtcacgtctaggtcagcccaagccaaccc

SEQ ID NO: 577462 - DNA, 518 bp, Homo sapiens
  misc_feature: HIJSMM301EXM12.7.86.H09.1.454.light.4.raw
cgtgtctctacacgaccggtgctcgatttagtgctatagacttgggtttggggagagctctggagaagagctgctcagttaggacccagagggaaccatggaaagcccagcacagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 577463 - DNA, 500 bp, Homo sapiens; identical to SEQ ID NO: 546613
  misc_feature: HIJSMM301AQ4DO.11.21.B10.1.454.light.4.raw

SEQ ID NO: 577464 - DNA, 447 bp, Homo sapiens; identical to SEQ ID NO: 535020
  misc_feature: HIJSMM301AIKKF.18.9.A09.1.454.light.4.raw

SEQ ID NO: 577465 - DNA, 506 bp, Homo sapiens
  misc_feature: HIJSMM301A9IAV.43.86.H09.1.454.light.4.raw
tgtgagtagtcacgaccggtgctcgatttagtgctatagacttgggtttgggggatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaaccgaactgtggctgcaccatctgt

SEQ ID NO: 577466 - DNA, 491 bp, Homo sapiens; identical to SEQ ID NO: 543050
  misc_feature: HIJSMM301CE1E4.10.72.G06.1.454.light.4.raw

SEQ ID NO: 577467 - DNA, 385 bp, Homo sapiens
  misc_feature: HIJSMM301EOJPE.49.78.H01.1.454.light.4.raw
agtcgagagacacgaccggtgctcgatttagtgtgagtagtttgggtttggggtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 577468 - DNA, 506 bp, Homo sapiens
  misc_feature: HIJSMM301BLABL.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggccactttcggcccgtgggaccgaacgtggatatacaaacgaactgtggctgcaccatctgtcttctatcc

SEQ ID NO: 577469 - DNA, 502 bp, Homo sapiens; identical to SEQ ID NO: 558110
  misc_feature: HIJSMM301EOYUH.4.6.A06.1.454.light.4.raw

SEQ ID NO: 577470 - DNA, 485 bp, Homo sapiens; identical to SEQ ID NO: 536040
  misc_feature: HIJSMM301C8B1U.15.1.A01.1.454.light.4.raw

SEQ ID NO: 577471 - DNA, 483 bp, Homo sapiens
  misc_feature: HIJSMM301BRVNF.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccacttcggccctggaccaaagtggatatcaaacgaactgtggctgcaccatctgtt

SEQ ID NO: 577472 - DNA, 492 bp, Homo sapiens
  misc_feature: HIJSMM301EMT4C.43.61.F06.1.454.light.4.raw
tgtgagtagtcacgaccggtgctcgatttagctacgctctaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaatacaaacgaactgtgctgcaccatctgtctt

SEQ ID NO: 577473 - DNA, 501 bp, Homo sapiens
  misc_feature: HIJSMM301D5HU3.18.11.A11.1.454.light.4.raw
  modified_base (469)..(469): a, c, t, g, unknown or other
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtgganatcaaacgaactgtggctgcaccatctgtctt

SEQ ID NO: 577474 - DNA, 494 bp, Homo sapiens; identical to SEQ ID NO: 534992
  misc_feature: HIJSMM301ERYXI.9.1.A01.1.454.light.4.raw

SEQ ID NO: 577475 - DNA, 502 bp, Homo sapiens; identical to SEQ ID NO: 537363
  misc_feature: HIJSMM301A0DJ8.18.23.C01.1.454.light.4.raw

SEQ ID NO: 577476 - DNA, 511 bp, Homo sapiens; identical to SEQ ID NO: 541549
  misc_feature: HIJSMM301AF1O8.40.33.C11.1.454.light.4.raw

SEQ ID NO: 577477 - DNA, 494 bp, Homo sapiens; identical to SEQ ID NO: 534994
  misc_feature: HIJSMM301CR7ZO.27.78.H01.1.454.light.4.raw

SEQ ID NO: 577478 - DNA, 497 bp, Homo sapiens; identical to SEQ ID NO: 535286
  misc_feature: HIJSMM301BTYA8.18.59.F04.1.454.light.4.raw

SEQ ID NO: 577479 - DNA, 454 bp, Homo sapiens; identical to SEQ ID NO: 536347
  misc_feature: HIJSMM301CUX4S.19.86.H09.1.454.light.4.raw

SEQ ID NO: 577480 - DNA, 498 bp, Homo sapiens
  misc_feature: HIJSMM301EZDPC.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtc

SEQ ID NO: 577481 - DNA, 496 bp, Homo sapiens
  misc_feature: HIJSMM301BS8IG.43.55.E11.1.454.light.4.raw
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatacaaacgaaactgtggctgcaccatctgtcttcat

SEQ ID NO: 577482 - DNA, 484 bp, Homo sapiens; identical to SEQ ID NO: 535400
  misc_feature: HIJSMM301DA2BI.46.26.C04.1.454.light.4.raw

SEQ ID NO: 577483 - DNA, 483 bp, Homo sapiens
  misc_feature: HIJSMM301C4JDU.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtccgctcactttcggcggagggaccaaggtggagatcaaacgaa

SEQ ID NO: 577484 - DNA, 505 bp, Homo sapiens
  misc_feature: HIJSMM301B1KQ9.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcta

SEQ ID NO: 577485 - DNA, 494 bp, Homo sapiens; identical to SEQ ID NO: 534992
  misc_feature: HIJSMM301BU04A.9.1.A01.1.454.light.4.raw

SEQ ID NO: 577486 - DNA, 486 bp, Homo sapiens; identical to SEQ ID NO: 535385
  misc_feature: HIJSMM301BP4H6.19.71.G05.1.454.light.4.raw

SEQ ID NO: 577487 - DNA, 378 bp, Homo sapiens
  misc_feature: HIJSMM301CVXCK.49.42.D09.1.454.light.4.raw
agtcgagagacacgaccggtgctcgatttagacacatacgcagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccaccctcctctctctcgact

SEQ ID NO: 577488 - DNA, 485 bp, Homo sapiens; identical to SEQ ID NO: 539315
  misc_feature: HIJSMM301AOKQP.3.88.H11.1.454.light.4.raw

SEQ ID NO: 577489 - DNA, 493 bp, Homo sapiens
  misc_feature: HIJSMM301CSK79.48.37.D04.1.454.light.4.raw
agtatacatacacgaccggtgctcgatttagtagcatactgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtctaggtcagcccaaggctg

SEQ ID NO: 577490 - DNA, 497 bp, Homo sapiens; identical to SEQ ID NO: 536376
  misc_feature: HIJSMM301E0O8R.22.9.A09.1.454.light.4.raw

SEQ ID NO: 577491 - DNA, 486 bp, Homo sapiens; identical to SEQ ID NO: 535290
  misc_feature: HIJSMM301B4SPR.3.12.B01.1.454.light.4.raw

SEQ ID NO: 577492 - DNA, 485 bp, Homo sapiens; identical to SEQ ID NO: 538053
  misc_feature: HIJSMM301BS57G.13.5.A05.1.454.light.4.raw

SEQ ID NO: 577493 - DNA, 490 bp, Homo sapiens
  misc_feature: HIJSMM301D6JKF.13.10.A10.1.454.light.4.raw
tcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgttggtatcaacagaaggccggccagtcacctacattggttatctatgaagacacgaagcggccctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgccccctcggtcta

SEQ ID NO: 577494 - DNA, 454 bp, Homo sapiens
  misc_feature: HIJSMM301EGIDN.19.86.H09.1.454.light.4.raw
  modified_base (450)..(450): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacganagta

SEQ ID NO: 577495 - DNA, 496 bp, Homo sapiens; identical to SEQ ID NO: 535423
  misc_feature: HIJSMM301DPLLC.3.33.C11.1.454.light.4.raw

SEQ ID NO: 577496 - DNA, 486 bp, Homo sapiens; identical to SEQ ID NO: 536323
  misc_feature: HIJSMM301AF1FH.10.2.A02.1.454.light.4.raw

SEQ ID NO: 577497 - DNA, 504 bp, Homo sapiens
  misc_feature: HIJSMM301BYUCW.4.71.G05.1.454.light.4.raw
  modified_base (237)..(237): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggtagggaccaaactgaccgtcctaggtcagcccaaggctgccccctggtcactctgtt

SEQ ID NO: 577498 - DNA, 516 bp, Homo sapiens
  misc_feature: HIJSMM301AII5U.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcacttcggtcggagggaccgacgggtgggaggagtacaaacgaaactacgtggtcgtcgtcgaccactacttcgtcgttctacttcc

SEQ ID NO: 577499 - DNA, 488 bp, Homo sapiens; identical to SEQ ID NO: 540827
  misc_feature: HIJSMM301EPS79.15.49.E05.1.454.light.4.raw

SEQ ID NO: 577500 - DNA, 507 bp, Homo sapiens; identical to SEQ ID NO: 538702
  misc_feature: HIJSMM301D5OAT.11.57.F02.1.454.light.4.raw

SEQ ID NO: 577501 - DNA, 494 bp, Homo sapiens; identical to SEQ ID NO: 534992
  misc_feature: HIJSMM301ECWMO.9.1.A01.1.454.light.4.raw

SEQ ID NO: 577502 - DNA, 491 bp, Homo sapiens; identical to SEQ ID NO: 535294
  misc_feature: HIJSMM301B3ZX8.16.68.G02.1.454.light.4.raw

SEQ ID NO: 577503 - DNA, 500 bp, Homo sapiens
  misc_feature: HIJSMM301DZGGR.48.78.H01.1.454.light.4.raw
agtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtctaggtcagcccaaggctgccccctc

SEQ ID NO: 577504 - DNA, 477 bp, Homo sapiens
  misc_feature: HIJSMM301AMA2S.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccacttcggcggagggaccaaggtggagatcaaacgaactgtggctgcaccactctgtt

SEQ ID NO: 577505 - DNA, 491 bp, Homo sapiens
  misc_feature: HIJSMM301B0U2Y.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtcctaacaggttcagtggcagtggatcaggcacagattttacactgaaaatcagcagagtggaggctgaggatgttggggtttatactgcatgcaagctctacaacctctgcggactttcggcctgggaccaaagtggagatcaaacgaactgtggctgcaccatctgtctt

SEQ ID NO: 577506 - DNA, 516 bp, Homo sapiens
  misc_feature: HIJSMM301DPG9P.17.28.C06.1.454.light.4.raw
cgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccacct

SEQ ID NO: 577507 - DNA, 441 bp, Homo sapiens; identical to SEQ ID NO: 535074
  misc_feature: HIJSMM301DNE6E.11.3.A03.1.454.light.4.raw

SEQ ID NO: 577508 - DNA, 501 bp, Homo sapiens
  misc_feature: HIJSMM301BNMMB.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 577509 - DNA, 504 bp, Homo sapiens; identical to SEQ ID NO: 539032
  misc_feature: HIJSMM301EPJP3.19.67.G01.1.454.light.4.raw

SEQ ID NO: 577510 - DNA, 491 bp, Homo sapiens; identical to SEQ ID NO: 543372
  misc_feature: HIJSMM301AT0TR.47.55.E11.1.454.light.4.raw

SEQ ID NO: 577511 - DNA, 505 bp, Homo sapiens
  misc_feature: HIJSMM301DG55U.8.28.C06.1.454.light.4.raw
ctcgcgtgtccacgaccggtgctcgatttagagctcacgtattgggtttgggggaggaactgcacagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 577512 - DNA, 491 bp, Homo sapiens; identical to SEQ ID NO: 535294
  misc_feature: HIJSMM301A2EO6.16.68.G02.1.454.light.4.raw

SEQ ID NO: 577513 - DNA, 497 bp, Homo sapiens
  misc_feature: HIJSMM301BUQZ7.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcacttcc

SEQ ID NO: 577514 - DNA, 502 bp, Homo sapiens; identical to SEQ ID NO: 537816
  misc_feature: HIJSMM301D58X6.19.78.H01.1.454.light.4.raw

SEQ ID NO: 577515 - DNA, 447 bp, Homo sapiens; identical to SEQ ID NO: 535020
  misc_feature: HIJSMM301BW1D3.18.9.A09.1.454.light.4.raw

SEQ ID NO: 577516 - DNA, 496 bp, Homo sapiens
  misc_feature: HIJSMM301BDIWS.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatgcaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttccccg

SEQ ID NO: 577517 - DNA, 493 bp, Homo sapiens
  misc_feature: HIJSMM301B5O8R.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaacgtaggacatcaagcgaactgtggctgcaccatctgtt

SEQ ID NO: 577518 - DNA, 481 bp, Homo sapiens; identical to SEQ ID NO: 566841
  misc_feature: HIJSMM301ADD28.7.76.G10.1.454.light.4.raw

SEQ ID NO: 577519 - DNA, 485 bp, Homo sapiens; identical to SEQ ID NO: 536576
  misc_feature: HIJSMM301DMBC2.46.35.D02.1.454.light.4.raw

SEQ ID NO: 577520 - DNA, 508 bp, Homo sapiens
  misc_feature: HIJSMM301DQYTI.4.71.G05.1.454.light.4.raw
  modified_base (446)..(446): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggnggagggaccaaactgaccgtctaggtcagccaaggctgccccctggtcactctcgttccccg

SEQ ID NO: 577521 - DNA, 499 bp, Homo sapiens
  misc_feature: HIJSMM301DA9WJ.51.9.A09.1.454.light.4.raw
cgatcgtatacacgaccggtgctcgatttagcgagacgcgcagggggcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcgggggaccgaaactgaccgtcctaggtcagcccaaggctgccccctcggt

SEQ ID NO: 577522 - DNA, 508 bp, Homo sapiens; identical to SEQ ID NO: 536062
  misc_feature: HIJSMM301DUYN5.11.57.F02.1.454.light.4.raw

SEQ ID NO: 577523 - DNA, 520 bp, Homo sapiens
  misc_feature: HIJSMM301A4AGH.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtgccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctcgttcccg

SEQ ID NO: 577524 - DNA, 497 bp, Homo sapiens
  misc_feature: HIJSMM301EEE4S.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccccc

SEQ ID NO: 577525 - DNA, 497 bp, Homo sapiens
  misc_feature: HIJSMM301ESFFS.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccgaagggacgacgactggagattaaaaggaactgtggctgcaccatctgtcttcatcttccccg

SEQ ID NO: 577526 - DNA, 484 bp, Homo sapiens; identical to SEQ ID NO: 535441
  misc_feature: HIJSMM301AJT6L.26.60.F05.1.454.light.4.raw

SEQ ID NO: 577527 - DNA, 499 bp, Homo sapiens
  misc_feature: HIJSMM301CNMCC.7.31.C09.1.454.light.4.raw
cgtgtctctacacgaccggtgctcgatttagacgtctcatcaaggaaggaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgacgtcctaggtcagccaaggctgcccctcc

SEQ ID NO: 577528 - DNA, 495 bp, Homo sapiens; identical to SEQ ID NO: 543631
  misc_feature: HIJSMM301A51VQ.11.59.F04.1.454.light.4.raw

SEQ ID NO: 577529 - DNA, 478 bp, Homo sapiens
  misc_feature: HIJSMM301D3VOR.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccgaaggtggagatcaaacgaactgtggctgca

SEQ ID NO: 577530 - DNA, 460 bp, Homo sapiens; identical to SEQ ID NO: 536053
  misc_feature: HIJSMM301AQ0GH.22.28.C06.1.454.light.4.raw

SEQ ID NO: 577531 - DNA, 491 bp, Homo sapiens
  misc_feature: HIJSMM301APREB.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtgacagtggatcaggcacagattttacactgaaaatcagcagagtggaggctgaggatgttggggtttattactgcatgcaagctctacaaactccttacacttttggccaggggaccaagctggagatcaaacgaactgt

SEQ ID NO: 577532 - DNA, 518 bp, Homo sapiens; identical to SEQ ID NO: 539372
  misc_feature: HIJSMM301BAU5N.7.86.H09.1.454.light.4.raw

SEQ ID NO: 577533 - DNA, 485 bp, Homo sapiens
  misc_feature: HIJSMM301CODT9.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagtattttactttcaccatcaccagcctgcagcctgaagatattgcaacatattactgtcaacagtatgataatcctccctcccactttcggcggaggaccaaggtggagatacaaacgactagtggctgca

SEQ ID NO: 577534 - DNA, 517 bp, Homo sapiens
  misc_feature: HIJSMM301B0ZNP.10.86.H09.1.454.light.4.raw
catagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctcccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 577535 - DNA, 508 bp, Homo sapiens
  misc_feature: HIJSMM301CUME4.48.15.B04.1.454.light.4.raw
agtatacatacacgaccggtgctcgattagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccgggggaccaacgtggaaatcaaacgaactagtggctgcaccatctgtcttcta

SEQ ID NO: 577536 - DNA, 487 bp, Homo sapiens; identical to SEQ ID NO: 547029
  misc_feature: HIJSMM301AQV2H.26.55.E11.1.454.light.4.raw

SEQ ID NO: 577537 - DNA, 476 bp, Homo sapiens
  misc_feature: HIJSMM301A1X0C.49.34.D01.1.454.light.4.raw
agtcgagagacacgaccggtgctcgatttagatcgtctgtgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttactttcaccatcagcaggctgcagcctgaagatattgcaacatattactgtcaacagtatgatagtctcccgctcactttcggcgggggaccgaaggtggagatcaagcgaactgtggctgca

SEQ ID NO: 577538 - DNA, 480 bp, Homo sapiens
  misc_feature: HIJSMM301EV8HB.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaaggtgcagatcaaacgaactgtgg

SEQ ID NO: 577539 - DNA, 454 bp, Homo sapiens; identical to SEQ ID NO: 536347
  misc_feature: HIJSMM301DGYHI.19.86.H09.1.454.light.4.raw

SEQ ID NO: 577540 - DNA, 493 bp, Homo sapiens
  misc_feature: HIJSMM301CHUBR.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggtagggaccaaaggtggaggtcaaacgaactgtggctgcaccatctgtcttcatt

SEQ ID NO: 577541 - DNA, 492 bp, Homo sapiens
  misc_feature: HIJSMM301A2LK0.49.24.C02.1.454.light.4.raw
agtcgagagacacgaccggtgctcgatttagtacagatcgttagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaacgaactgtggctgcaccatctgtctt

SEQ ID NO: 577542 - DNA, 477 bp, Homo sapiens
  misc_feature: HIJSMM301A8Z24.48.2.A02.1.454.light.4.raw
agtatacatacacgaccggtgctcgatttagactcatctacaggggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccaaacgtggatgtcaaccgaactgtggctgcacca

SEQ ID NO: 577543 - DNA, 480 bp, Homo sapiens
  misc_feature: HIJSMM301B3Z9N.51.20.B09.1.454.light.4.raw
cgatcgtatacacgaccggtgctcgatttagtgtagtgtgagggaaagggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcgggacagggtatgatgtacactggtaccagcagcttccaggaacagcccccaaactcctcatttattctaacacccatcggccctcaggggtccctgatcgattctctggctccaagtctggcacctcagcctccctggccatcactggactccaggctgaggatgaggctgattattactgccagtcctatgacatcagcctgagtggttcgtgggtattcggcggagggacc

SEQ ID NO: 577544 - DNA, 489 bp, Homo sapiens; identical to SEQ ID NO: 537328
  misc_feature: HIJSMM301A2H99.13.5.A05.1.454.light.4.raw

SEQ ID NO: 577545 - DNA, 497 bp, Homo sapiens
  misc_feature: HIJSMM301AUIHL.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaattttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgactgtggctgcaccatctgtcttca

SEQ ID NO: 577546 - DNA, 485 bp, Homo sapiens; identical to SEQ ID NO: 535963
  misc_feature: HIJSMM301BKVZB.15.28.C06.1.454.light.4.raw

SEQ ID NO: 577547 - DNA, 490 bp, Homo sapiens; identical to SEQ ID NO: 538273
  misc_feature: HIJSMM301BWO8S.16.73.G07.1.454.light.4.raw

SEQ ID NO: 577548 - DNA, 495 bp, Homo sapiens
  misc_feature: HIJSMM301C3EI2.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctggtcactctgttcccta

SEQ ID NO: 577549 - DNA, 493 bp, Homo sapiens
  misc_feature: HIJSMM301CEXP5.49.70.G04.1.454.light.4.raw
  modified_base (461)..(461): a, c, t, g, unknown or other
agtcgagagacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccgggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaaggtggagatnaaacgaactgtggctgcaccatctgtcttcta

SEQ ID NO: 577550 - DNA, 500 bp, Homo sapiens; identical to SEQ ID NO: 569837
  misc_feature: HIJSMM301BN7HH.48.83.H06.1.454.light.4.raw

SEQ ID NO: 577551 - DNA, 501 bp, Homo sapiens
  misc_feature: HIJSMM301BB8SP.43.24.C02.1.454.light.4.raw
tgtgagtagtcacgaccggtgctcgatttagtacagatcgttagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggttattataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctggaggacgaggctgattattattgcagttcatatacaagcagcaccactattatgtcttcggagctgggaccaaggtcaccgtcctaggtcagcccaaggccaaccc

SEQ ID NO: 577552 - DNA, 485 bp, Homo sapiens
  misc_feature: HIJSMM301CWPR1.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggcctgggaccaaagtggagatcaaacgaa

SEQ ID NO: 577553 - DNA, 505 bp, Homo sapiens; identical to SEQ ID NO: 535987
  misc_feature: HIJSMM301DMKJP.18.37.D04.1.454.light.4.raw

SEQ ID NO: 577554 - DNA, 500 bp, Homo sapiens; identical to SEQ ID NO: 566764
  misc_feature: HIJSMM301BAJ3K.48.67.G01.1.454.light.4.raw

SEQ ID NO: 577555 - DNA, 513 bp, Homo sapiens; identical to SEQ ID NO: 535719
  misc_feature: HIJSMM301DV99J.17.33.C11.1.454.light.4.raw

SEQ ID NO: 577556 - DNA, 483 bp, Homo sapiens
  misc_feature: HIJSMM301DWUYF.49.24.C02.1.454.light.4.raw
  modified_base (472)..(472): a, c, t, g, unknown or other
agtcgagagacacgaccggtgctcgatttagtacagatcgttagggaaagggggagtcagacccagtcaggacacagcatggacatgagggtccccgctcagctcctggggctcctgctgctctggctcccaggtgccaaatgtgacatccagatgacccagtctccttccctttgtctgcatctgttggagacagagtcaccatcacttgccgggccactgagaacattaatcgctggttggcctggtatcagcagaaaccagggaaagcccctgaggccctcatctatctggcgtctagtttagagagtgggtcccgatcaagattcagcggcaatggatctgggacagaattcactctcaccattagcagcctgcagcctgatgatcttgcaacttattactgccaacattataatagttataatgtacatttttggcctagggaccaagttggagaatcaacgaactntggctgcacat

SEQ ID NO: 577557 - DNA, 520 bp, Homo sapiens
  misc_feature: HIJSMM301CC6EY.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcacgccaacggccaaccccactgtcactctgttcccgccctcctccgtgt

SEQ ID NO: 577558 - DNA, 504 bp, Homo sapiens
  misc_feature: HIJSMM301B2JC7.49.31.C09.1.454.light.4.raw
agtcgagagacacgaccggtgctcgatttagacgtctcatcaaggaaggaagggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattattactgcagctcatctgcaggcattaacaattttaatgtggtattcggcggagggaccaagctgaccgtcctaggtcagcccaaggctgccccctcggtcactctgttcccg

SEQ ID NO: 577559 - DNA, 491 bp, Homo sapiens; identical to SEQ ID NO: 556219
  misc_feature: HIJSMM301BM6P6.12.57.F02.1.454.light.4.raw

SEQ ID NO: 577560 - DNA, 521 bp, Homo sapiens; identical to SEQ ID NO: 538715
  misc_feature: HIJSMM301CKA8E.27.23.C01.1.454.light.4.raw

SEQ ID NO: 577561 - DNA, 509 bp, Homo sapiens
  misc_feature: HIJSMM301E0L13.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagttgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacaccctcactttcggcggaggggccaaggtggagatcaagcgaactgtggctgcaccatctgtcttcatcttcccg

SEQ ID NO: 577562 - DNA, 453 bp, Homo sapiens; identical to SEQ ID NO: 544521
  misc_feature: HIJSMM301CG034.19.86.H09.1.454.light.4.raw

SEQ ID NO: 577563 - DNA, 475 bp, Homo sapiens
  misc_feature: HIJSMM301EK8QJ.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgcttcactttcggcggagggaccaaggtggagatcaaacgaactgtgg

SEQ ID NO: 577564 - DNA, 488 bp, Homo sapiens
  misc_feature: HIJSMM301CAWVE.49.87.H10.1.454.light.4.raw
agtcgagagacacgaccggtgctcgatttagcagtactgcgttgggtttgggggagtcagtcccaaccaggacacagcatggacatgagggtccctgctcagctcctggggctcctgctgctctggctcccaggtgccagatgtgacatccagttgacccagtctccatccttcctgtctgcatctgtcggagacagagtcaccatcacttgccgggccagtcagggcgttagtagttatttagcctggtatcaacaaaaaccagggaaagcccctaacctcctgatatatgctgcaaccactttgcaaagtggggtcccatcaaggttcagcggcagtggatctgggacagagttcactctcactatcagcagcctgcagcctgaagattttgcaacttattattgccatcaagttgatgcttacccgctcactttcggcggagggaccacggtggagatcaaagaactgtggctgcaccatctgtt

SEQ ID NO: 577565 - DNA, 501 bp, Homo sapiens; identical to SEQ ID NO: 536867
  misc_feature: HIJSMM301B0H60.5.86.H09.1.454.light.4.raw

SEQ ID NO: 577566 - DNA, 492 bp, Homo sapiens
  misc_feature: HIJSMM301D6Z7D.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtaggaaatacaaacgaactgtggctgcaccatctgtcttcta

SEQ ID NO: 577567 - DNA, 503 bp, Homo sapiens; identical to SEQ ID NO: 537216
  misc_feature: HIJSMM301BA52Z.3.70.G04.1.454.light.4.raw

SEQ ID NO: 577568 - DNA, 496 bp, Homo sapiens; identical to SEQ ID NO: 559406
  misc_feature: HIJSMM301A9ND4.51.39.D06.1.454.light.4.raw

SEQ ID NO: 577569 - DNA, 499 bp, Homo sapiens
  misc_feature: HIJSMM301BNE90.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtctcatcttcccgccat

SEQ ID NO: 577570 - DNA, 509 bp, Homo sapiens; identical to SEQ ID NO: 535670
  misc_feature: HIJSMM301CO4PN.47.23.C01.1.454.light.4.raw

SEQ ID NO: 577571 - DNA, 488 bp, Homo sapiens
  misc_feature: HIJSMM301BW0I0.52.25.C03.1.454.light.4.raw
  modified_base (471)..(471): a, c, t, g, unknown or other
cgcagtacgacacgaccggtgctcgatttagtagtgtagatttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagtattttgcaacttattactgtccaacaccttaatagttactccttcactttcggccctgggaccaaagtggacatcaaacgaactgngctgcaccatctgtctt

SEQ ID NO: 577572 - DNA, 497 bp, Homo sapiens
  misc_feature: HIJSMM301BM0EF.41.82.H05.1.454.light.4.raw
tctatactatcacgaccggtgctcgatttagtcgagctctctcgcgggagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatacaaacgaactagtggctgcaccatctgtcttcatcttcccgccta

SEQ ID NO: 577573 - DNA, 513 bp, Homo sapiens; identical to SEQ ID NO: 535244
  misc_feature: HIJSMM301B6I0U.17.33.C11.1.454.light.4.raw

SEQ ID NO: 577574 - DNA, 521 bp, Homo sapiens
  misc_feature: HIJSMM301CJVRQ.43.45.E01.1.454.light.4.raw
tgtgagtagtcacgaccggtgctcgatttagtgagtcagtaagggaaaggggggcctgaggaagcagcactggtggtgcctcagccatggcctggaccgttctcctcctcggcctcctctctcactgcacaggctccgtgacctcctatgaactgactcagcccccctcggtgtctgtggccccaggacagacggccagcattacctgtgggggatacaactttgcccagaaaaatgtacattggtatcagcagaaggcaggccaggcccctgtgatggtcgtctgtgacgatagggaccggccctcggggatccttgagcgattctctggctccaagtctgggaacacggccactctgaccatcagccgggtcgaggccggggacgaggccgactattattgtcaactgtgggatggtactggtgaccggtactgggtgttcggcggagggaccaagctgaccgtcctaggtcagcccaaggctgccccctcggtcactctgttcccaccctcctcacta

SEQ ID NO: 577575 - DNA, 486 bp, Homo sapiens; identical to SEQ ID NO: 535917
  misc_feature: HIJSMM301CVZZT.3.10.A10.1.454.light.4.raw

SEQ ID NO: 577576 - DNA, 500 bp, Homo sapiens; identical to SEQ ID NO: 567552
  misc_feature: HIJSMM301D5AMK.5.24.C02.1.454.light.4.raw

SEQ ID NO: 577577 - DNA, 444 bp, Homo sapiens; identical to SEQ ID NO: 534993
  misc_feature: HIJSMM301B80B5.5.9.A09.1.454.light.4.raw

SEQ ID NO: 577578 - DNA, 500 bp, Homo sapiens
  misc_feature: HIJSMM301BWKEL.52.27.C05.1.454.light.4.raw
cgcagtacgacacgaccggtgctcgatttagacgcgatcgaagggtttgggggtgggggcacttctccctctaacactctccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctgggaccagagtggatatacaaacgaactgtggctgcaccatctgtcttcatcttcccgccatctgata

SEQ ID NO: 577579 - DNA, 508 bp, Homo sapiens
  misc_feature: HIJSMM301CBHZJ.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggaggatcaaacgaactgtggctgcaccatctgtcttcta

SEQ ID NO: 577580 - DNA, 507 bp, Homo sapiens
  misc_feature: HIJSMM301EUHP3.15.86.H09.1.454.light.4.raw
tctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcacg

SEQ ID NO: 577581 - DNA, 494 bp, Homo sapiens; identical to SEQ ID NO: 539784
  misc_feature: HIJSMM301AF4HU.22.57.F02.1.454.light.4.raw

SEQ ID NO: 577582 - DNA, 492 bp, Homo sapiens; identical to SEQ ID NO: 537395
  misc_feature: HIJSMM301CXCTI.16.73.G07.1.454.light.4.raw

SEQ ID NO: 577583 - DNA, 498 bp, Homo sapiens
  misc_feature: HIJSMM301A07WD.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccacgggtggaaatcaaacgaactagtggctgcaccatctgtcttctatt

SEQ ID NO: 577584 - DNA, 506 bp, Homo sapiens
  misc_feature: HIJSMM301CKOKP.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagattttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttcccgccctcctccgtgt

SEQ ID NO: 577585 - DNA, 503 bp, Homo sapiens
  misc_feature: HIJSMM301AX3A4.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctagggtcagcccaa

SEQ ID NO: 577586 - DNA, 499 bp, Homo sapiens
  misc_feature: HIJSMM301D5J20.15.57.F02.1.454.light.4.raw
  modified_base (482)..(482): a, c, t, g, unknown or other
tctacgtagccacgaccggtgctcgatttagctcgatatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgcccctcggtcactctgttcccnccctcctcgctcgtaga

SEQ ID NO: 577587 - DNA, 511 bp, Homo sapiens
  misc_feature: HIJSMM301E2T6M.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaagtacttattacttcgtctaacgaagtactacaactaattactcgtacggtacggttccggtaccggaacggaacggaacggtaaggtaacgtaacgaaacgtaacgtagt

SEQ ID NO: 577588 - DNA, 513 bp, Homo sapiens
  misc_feature: HIJSMM301B7V5A.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagtttaatagtgatcatccgggggtattcggcggagggaccaaggtgaccgtcctacgtcagcccaaggctgccccctcggtcactctgttcccaccctcctc

SEQ ID NO: 577589 - DNA, 499 bp, Homo sapiens; identical to SEQ ID NO: 536875
  misc_feature: HIJSMM301DNXQ3.51.26.C04.1.454.light.4.raw

SEQ ID NO: 577590 - DNA, 504 bp, Homo sapiens
  misc_feature: HIJSMM301DB6ON.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccgacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtt

SEQ ID NO: 577591 - DNA, 501 bp, Homo sapiens; identical to SEQ ID NO: 560712
  misc_feature: HIJSMM301CHFIJ.5.24.C02.1.454.light.4.raw

SEQ ID NO: 577592 - DNA, 472 bp, Homo sapiens; identical to SEQ ID NO: 536302
  misc_feature: HIJSMM301BFFPA.18.76.G10.1.454.light.4.raw

SEQ ID NO: 577593 - DNA, 521 bp, Homo sapiens; identical to SEQ ID NO: 539470
  misc_feature: HIJSMM301BFJD2.27.23.C01.1.454.light.4.raw

SEQ ID NO: 577594 - DNA, 485 bp, Homo sapiens; identical to SEQ ID NO: 539576
  misc_feature: HIJSMM301EG1SI.4.57.F02.1.454.light.4.raw

SEQ ID NO: 577595 - DNA, 501 bp, Homo sapiens
  misc_feature: HIJSMM301CEFJP.10.68.G02.1.454.light.4.raw
catagtagtgcacgaccggtgctcgattagtcgatagtgaagggaaaggggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagcccaaggctcgccccctcggtcact

SEQ ID NO: 577596 - DNA, 485 bp, Homo sapiens
  misc_feature: HIJSMM301DAD1L.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcgacaggggatctgggacagatttcactctcaccatcagcagcctgcagcctgaagattttgcaacttactattgtcaacaggctaacagtttccctttaatcttcggccaagggacacgactggagattaaacgaactgtggctgcacca

SEQ ID NO: 577597 - DNA, 488 bp, Homo sapiens; identical to SEQ ID NO: 537673
  misc_feature: HIJSMM301DAZDI.12.31.C09.1.454.light.4.raw

SEQ ID NO: 577598 - DNA, 502 bp, Homo sapiens; identical to SEQ ID NO: 536253
  misc_feature: HIJSMM301ETGT5.21.22.B11.1.454.light.4.raw

SEQ ID NO: 577599 - DNA, 502 bp, Homo sapiens; identical to SEQ ID NO: 543172
  misc_feature: HIJSMM301DPX7F.18.59.F04.1.454.light.4.raw

SEQ ID NO: 577600 - DNA, 486 bp, Homo sapiens
  misc_feature: HIJSMM301EFXJT.46.35.D02.1.454.light.4.raw
actagcagtacacgaccggtgctcgatttagcacacgatagttgggtttgggggagctgcacagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 577601 - DNA, 505 bp, Homo sapiens; identical to SEQ ID NO: 535503
  misc_feature: HIJSMM301AZ5BD.8.28.C06.1.454.light.4.raw

SEQ ID NO: 577602 - DNA, 503 bp, Homo sapiens; identical to SEQ ID NO: 540029
  misc_feature: HIJSMM301D2A2E.7.71.G05.1.454.light.4.raw

SEQ ID NO: 577603 - DNA, 494 bp, Homo sapiens
  misc_feature: HIJSMM301DWTKY.52.80.H03.1.454.light.4.raw
cgcagtacgacacgaccggtgctcgatttagctgtgcgtcgaagggaaaggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaacccactgtca

SEQ ID NO: 577604 - DNA, 484 bp, Homo sapiens
  misc_feature: HIJSMM301DBB92.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggccaaactgaccgtcctaggtcagcccaaggctgccccctcggtcactctgttcccaccctcctctacgtgagct

SEQ ID NO: 577605 - DNA, 495 bp, Homo sapiens
  misc_feature: HIJSMM301BT7UF.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaacgtggagtaatcagacgaaactgtgg

SEQ ID NO: 577606 - DNA, 482 bp, Homo sapiens
  misc_feature: HIJSMM301DYNER.53.33.C11.1.454.light.4.raw
cgcgtatacacacgaccggtgctcgatttagagtgagctcgttgggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattggaggataaatatacttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattattgtcgaggcggtgggacagaccaaccctgtagttgggttggttcgggcggaggaaccaactgaccgtctaggtcacg

SEQ ID NO: 577607 - DNA, 484 bp, Homo sapiens; identical to SEQ ID NO: 535400
  misc_feature: HIJSMM301ATO03.46.26.C04.1.454.light.4.raw

SEQ ID NO: 577608 - DNA, 497 bp, Homo sapiens
  misc_feature: HIJSMM301CA3PJ.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggatgaggctgactattactgccagtcctatgacatgaggctgagtggttcgtatgtcttcggatctgggaccaaggtcaccgtcctaagtcagcccaa

SEQ ID NO: 577609 - DNA, 482 bp, Homo sapiens; identical to SEQ ID NO: 535352
  misc_feature: HIJSMM301CZOMH.16.81.H04.1.454.light.4.raw

SEQ ID NO: 577610 - DNA, 489 bp, Homo sapiens
  misc_feature: HIJSMM301D0BFN.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacatcaagcgaactagtggctgcaccatct

SEQ ID NO: 577611 - DNA, 494 bp, Homo sapiens; identical to SEQ ID NO: 535276
  misc_feature: HIJSMM301B3HK6.16.6.A06.1.454.light.4.raw

SEQ ID NO: 577612 - DNA, 479 bp, Homo sapiens; identical to SEQ ID NO: 536050
  misc_feature: HIJSMM301CV25Y.5.73.G07.1.454.light.4.raw

SEQ ID NO: 577613 - DNA, 444 bp, Homo sapiens; identical to SEQ ID NO: 535411
  misc_feature: HIJSMM301DT108.8.73.G07.1.454.light.4.raw

SEQ ID NO: 577614 - DNA, 493 bp, Homo sapiens
  misc_feature: HIJSMM301A9N7L.27.78.H01.1.454.light.4.raw
  modified_base (413)..(413): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcaagngtactacttactcaagtgatcaccttcggccaagggacacgactggagattaaacgaactgtggctgcaccatctgtctt

SEQ ID NO: 577615 - DNA, 505 bp, Homo sapiens; identical to SEQ ID NO: 547532
  misc_feature: HIJSMM301C5WCF.8.1.A01.1.454.light.4.raw

SEQ ID NO: 577616 - DNA, 508 bp, Homo sapiens; identical to SEQ ID NO: 537871
  misc_feature: HIJSMM301AUD3U.8.33.C11.1.454.light.4.raw

SEQ ID NO: 577617 - DNA, 494 bp, Homo sapiens
  misc_feature: HIJSMM301CZSQ4.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggaagtgggtctgggacagagttcactctcaccatcagcagcctgcagtctgaagattttgcagtttattactgtcagcagtataattactggcctcggacgttcggccaagggaccaaggtggaagtcaaacgaactgtggctgcaccatctgtcttcta

SEQ ID NO: 577618 - DNA, 491 bp, Homo sapiens
  misc_feature: HIJSMM301BQI3X.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactacctctcactttcggaggagggaccaggtggagatcaaacgaactgtggctgcaccatctgtcttcta

SEQ ID NO: 577619 - DNA, 486 bp, Homo sapiens
  misc_feature: HIJSMM301DYV8D.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacatccggccctgggaccaaagtggagatcaaacgaa

SEQ ID NO: 577620 - DNA, 502 bp, Homo sapiens
  misc_feature: HIJSMM301D4KDD.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcgaagatgaggctgactattattgtaagtccgggacagaagtggtaattacatggtgttcggcggagggaccaagctgaccgtcctacgtcagcccaaggctcgcccctcggtcact

SEQ ID NO: 577621 - DNA, 517 bp, Homo sapiens
  misc_feature: HIJSMM301B7N2E.41.35.D02.1.454.light.4.raw
tctatactatcacgaccggtgctcgatttagcacacgatagttgggtttggggagtctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccgt

SEQ ID NO: 577622 - DNA, 493 bp, Homo sapiens; identical to SEQ ID NO: 535047
  misc_feature: HIJSMM301EX636.16.53.E09.1.454.light.4.raw

SEQ ID NO: 577623 - DNA, 490 bp, Homo sapiens
  misc_feature: HIJSMM301EJPVO.49.42.D09.1.454.light.4.raw
agtcgagagacacgaccggtgctcgatttagacacatacgcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtt

SEQ ID NO: 577624 - DNA, 512 bp, Homo sapiens
  misc_feature: HIJSMM301AI039.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccgcctcctcgctacgtaga

SEQ ID NO: 577625 - DNA, 496 bp, Homo sapiens
  misc_feature: HIJSMM301BV5A9.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccattggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 577626 - DNA, 518 bp, Homo sapiens
  misc_feature: HIJSMM301AWKFD.3.87.H10.1.454.light.4.raw
agacgcactccacgaccggtgctcgatttagcagtactgcgttggggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcact

SEQ ID NO: 577627 - DNA, 507 bp, Homo sapiens
  misc_feature: HIJSMM301ASRT3.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtggaaatacaaacgaacctagtggctgcaccatctgtcttctatcttccccg

SEQ ID NO: 577628 - DNA, 516 bp, Homo sapiens
  misc_feature: HIJSMM301AI1D4.40.87.H10.1.454.light.4.raw
tctagcgactcacgaccggtgctcgatttagcagtactgcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgaggtgactattactgtgcagcttgggatgagagcctgagaggttggctgttcggcggagggaccaagctgaccgtcctaggtcagcccaaggctgccccctcggtcactc

SEQ ID NO: 577629 - DNA, 481 bp, Homo sapiens; identical to SEQ ID NO: 535628
  misc_feature: HIJSMM301D0QR5.14.11.A11.1.454.light.4.raw

SEQ ID NO: 577630 - DNA, 491 bp, Homo sapiens; identical to SEQ ID NO: 550287
  misc_feature: HIJSMM301CNR52.14.36.D03.1.454.light.4.raw

SEQ ID NO: 577631 - DNA, 500 bp, Homo sapiens; identical to SEQ ID NO: 546613
  misc_feature: HIJSMM301AN99R.11.21.B10.1.454.light.4.raw

SEQ ID NO: 577632 - DNA, 502 bp, Homo sapiens; identical to SEQ ID NO: 557124
  misc_feature: HIJSMM301APPP5.10.43.D10.1.454.light.4.raw

SEQ ID NO: 577633 - DNA, 494 bp, Homo sapiens; identical to SEQ ID NO: 534992
  misc_feature: HIJSMM301E28SP.9.1.A01.1.454.light.4.raw

SEQ ID NO: 577634 - DNA, 494 bp, Homo sapiens
  misc_feature: HIJSMM301A58F0.4.22.B11.1.454.light.4.raw
agcactgtagcacgaccggtgctcgatttagacgacagctcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtactacttttggccgaggggaccaagctggagatacaaacgaactgtggctgcaccat

SEQ ID NO: 577635 - DNA, 496 bp, Homo sapiens; identical to SEQ ID NO: 541772
  misc_feature: HIJSMM301BZ3TB.51.81.H04.1.454.light.4.raw

SEQ ID NO: 577636 - DNA, 441 bp, Homo sapiens; identical to SEQ ID NO: 535074
  misc_feature: HIJSMM301CA1G1.11.3.A03.1.454.light.4.raw

SEQ ID NO: 577637 - DNA, 491 bp, Homo sapiens; identical to SEQ ID NO: 563425
  misc_feature: HIJSMM301AHWFL.43.82.H05.1.454.light.4.raw

SEQ ID NO: 577638 - DNA, 492 bp, Homo sapiens; identical to SEQ ID NO: 540973
  misc_feature: HIJSMM301BJQ4A.43.20.B09.1.454.light.4.raw

SEQ ID NO: 577639 - DNA, 501 bp, Homo sapiens; identical to SEQ ID NO: 536142
  misc_feature: HIJSMM301D2KCY.15.1.A01.1.454.light.4.raw

SEQ ID NO: 577640 - DNA, 514 bp, Homo sapiens
  misc_feature: HIJSMM301CRQMA.48.29.C07.1.454.light.4.raw
agtatacatacacgaccggtgctcgatttagagtgctacgaagggaaagggggctgtgggtccaggaggcagaactctgggtgtctcaccatggcctgggtccccctacttctccccctcctcactctctgcacaggctctcaggcctcctatgagttgacacagccaccctcggtgtcagtgtccccaggacagacggccaggatcacctgctctggagatggattgccaacacaatatgcgtactggtaccagaagaagccaggccaggcccctgttttggtgatatatcaagacactcagagggcctcagggacccctgagcggttctctggctccagctcaggggcaacagtcgcgttgacaatcagggaagtccaggcagaggacgaggctgactattactgtcagtctgcagacaacggaggtacttacttggtcttcggcggagggaccaagttgaacgtcctgggtcagcccaaggctgcccctcggtcactctgtcccgcctcct

SEQ ID NO: 577641 - DNA, 488 bp, Homo sapiens; identical to SEQ ID NO: 542699
  misc_feature: HIJSMM301AOVC8.12.51.E07.1.454.light.4.raw

SEQ ID NO: 577642 - DNA, 512 bp, Homo sapiens
  misc_feature: HIJSMM301ANZP9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccgaagggaccgaacggtaggaaatacaaaccgaaactagtggctgcaccatctgtcttcatcttccccg

SEQ ID NO: 577643 - DNA, 494 bp, Homo sapiens; identical to SEQ ID NO: 534994
  misc_feature: HIJSMM301DI1CI.27.78.H01.1.454.light.4.raw

SEQ ID NO: 577644 - DNA, 476 bp, Homo sapiens; identical to SEQ ID NO: 537368
  misc_feature: HIJSMM301D0HUF.7.83.H06.1.454.light.4.raw

SEQ ID NO: 577645 - DNA, 503 bp, Homo sapiens
  misc_feature: HIJSMM301DZ43G.21.38.D05.1.454.light.4.raw
tcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccg

SEQ ID NO: 577646 - DNA, 491 bp, Homo sapiens
  misc_feature: HIJSMM301DNEI6.49.42.D09.1.454.light.4.raw
agtcgagagacacgaccggtgctcgatttagacacatacgcagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcagggtccctgatcgcttctctgcctccaagtctggcaacacggcctccctgaccatctctgggctccaggctgaggatgaggctcattattattgttgctcatatgcaggcaacttcgcttttgtcttcggaactgggaccgaggtcacgtcctgggtcagcccaagg

SEQ ID NO: 577647 - DNA, 513 bp, Homo sapiens; identical to SEQ ID NO: 535244
  misc_feature: HIJSMM301B6HRZ.17.33.C11.1.454.light.4.raw

SEQ ID NO: 577648 - DNA, 460 bp, Homo sapiens; identical to SEQ ID NO: 536053
  misc_feature: HIJSMM301A8KAS.22.28.C06.1.454.light.4.raw

SEQ ID NO: 577649 - DNA, 484 bp, Homo sapiens; identical to SEQ ID NO: 535240
  misc_feature: HIJSMM301BOFC5.47.60.F05.1.454.light.4.raw

SEQ ID NO: 577650 - DNA, 486 bp, Homo sapiens; identical to SEQ ID NO: 536261
  misc_feature: HIJSMM301DBI31.26.55.E11.1.454.light.4.raw

SEQ ID NO: 577651 - DNA, 494 bp, Homo sapiens; identical to SEQ ID NO: 535828
  misc_feature: HIJSMM301AGUUE.3.36.D03.1.454.light.4.raw

SEQ ID NO: 577652 - DNA, 503 bp, Homo sapiens
  misc_feature: HIJSMM301DVWNX.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtctaagtcagcccaaggccaacccactgtcactctgttcccaccct

SEQ ID NO: 577653 - DNA, 441 bp, Homo sapiens; identical to SEQ ID NO: 535074
  misc_feature: HIJSMM301EEKMG.11.3.A03.1.454.light.4.raw

SEQ ID NO: 577654 - DNA, 475 bp, Homo sapiens
  misc_feature: HIJSMM301BXYIY.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcacg

SEQ ID NO: 577655 - DNA, 468 bp, Homo sapiens
  misc_feature: HIJSMM301BK3P0.49.53.E09.1.454.light.4.raw
agtcgagagacacgaccggtgctcgatttagagagagtgtgttgggtttggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggccaggggaccaggctggatatcagacgaa

SEQ ID NO: 577656 - DNA, 496 bp, Homo sapiens; identical to SEQ ID NO: 537925
  misc_feature: HIJSMM301A4R3H.22.14.B03.1.454.light.4.raw

SEQ ID NO: 577657 - DNA, 494 bp, Homo sapiens; identical to SEQ ID NO: 537501
  misc_feature: HIJSMM301BORST.10.79.H02.1.454.light.4.raw

SEQ ID NO: 577658 - DNA, 354 bp, Homo sapiens
  misc_feature: HIJSMM301EV4JA.52.71.G05.1.454.light.4.raw
cgcagtacgacacgaccggtgctcgatttagtgtcgtcgcaagagagaggggggggtgagggttgagaacctatgaacattctgtaggggccactgtcttctccacgcacgctcatctacagcacaattactcgctcttctggggtccctgatcgcttctctggctccatccttgggaacaaagctgccctaaccatcacgggggcccaggcagatgatgaatctgattattactgtgtcctctatatgggtagtggcatttggatgttcggcggagggaccaagctgaccgtcctgggtcagcccaaggctgccccctcggtcactctgttcccaccctcctctatacgatcg

SEQ ID NO: 577659 - DNA, 506 bp, Homo sapiens
  misc_feature: HIJSMM301EI0K8.48.15.B04.1.454.light.4.raw
  modified_base (374)..(374): a, c, t, g, unknown or other
agtatacatacacgaccggtgctcgatttagacagtatatatccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttttcacacctccatgaacaaggagtacttggcttggttccagcagaaaccagggcagcctcctaaactactcatttactcggcatccacccggaagtccgaggttcctgaccgattccgtggcagcgggtctgggacagattttacnctcaccatcactaccctgcaggctgaagatgtggcagtttatactgtcaacaatattattctactccgccgacgttcggccggggaccaacgtggaaatcaaacgaactgtggctgcaccatctgtcttcta

SEQ ID NO: 577660 - DNA, 492 bp, Homo sapiens; identical to SEQ ID NO: 566665
  misc_feature: HIJSMM301D97RL.26.78.H01.1.454.light.4.raw

SEQ ID NO: 577661 - DNA, 501 bp, Homo sapiens
  misc_feature: HIJSMM301B81WY.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtccgaagggaccgagggtggaaagtacaaacgaactagtggctgcaccatctgtcttcatt

SEQ ID NO: 577662 - DNA, 513 bp, Homo sapiens
  misc_feature: HIJSMM301CDADT.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggcgaggctgattattactgccactcatatagaagtagtactactcctgtggttttcggcggagggaccaagctgaccgtcctaggtcagcccaaggctgccccctcggtcactctgttccccg

SEQ ID NO: 577663 - DNA, 517 bp, Homo sapiens
  misc_feature: HIJSMM301EIQLJ.12.71.G05.1.454.light.4.raw
atacgacgtacacgaccggtgctcgatttagtgtcgtcgcaagagagagggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttttgacctagtctcctggtaccaacaataccccggcaaagtccccaagttaatcatttatgaggacactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccacct

SEQ ID NO: 577664 - DNA, 502 bp, Homo sapiens; identical to SEQ ID NO: 537816
  misc_feature: HIJSMM301D1XZA.19.78.H01.1.454.light.4.raw

SEQ ID NO: 577665 - DNA, 503 bp, Homo sapiens; identical to SEQ ID NO: 536760
  misc_feature: HIJSMM301EWI1L.47.55.E11.1.454.light.4.raw

SEQ ID NO: 577666 - DNA, 491 bp, Homo sapiens
  misc_feature: HIJSMM301ADLBL.5.47.E03.1.454.light.4.raw
atcagacacgcacgaccggtgctcgatttagactcgcgcacagagagaagggggaagagctgctcagttaggacccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggcatcccacgtaggttcagtggcagtgggtctgggacagacttcactctcaccatcagcagactggagcctgaagattttgcagtgtattactgtcagcagtatgggctctcacctttcacttttcggcggagggaccaaggtggagaacaaacgaactagtggctgcaccat

SEQ ID NO: 577667 - DNA, 501 bp, Homo sapiens; identical to SEQ ID NO: 536142
  misc_feature: HIJSMM301BS0YB.15.1.A01.1.454.light.4.raw

SEQ ID NO: 577668 - DNA, 444 bp, Homo sapiens; identical to SEQ ID NO: 535027
  misc_feature: HIJSMM301CNLOE.8.73.G07.1.454.light.4.raw

SEQ ID NO: 577669 - DNA, 489 bp, Homo sapiens; identical to SEQ ID NO: 535946
  misc_feature: HIJSMM301EMME3.49.33.C11.1.454.light.4.raw

SEQ ID NO: 577670 - DNA, 494 bp, Homo sapiens; identical to SEQ ID NO: 535629
  misc_feature: HIJSMM301BTKNA.4.27.C05.1.454.light.4.raw

SEQ ID NO: 577671 - DNA, 503 bp, Homo sapiens; identical to SEQ ID NO: 538884
  misc_feature: HIJSMM301EOMDR.27.78.H01.1.454.light.4.raw

SEQ ID NO: 577672 - DNA, 488 bp, Homo sapiens
  misc_feature: HIJSMM301DCEVL.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgtcagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggtccaggggaccaaactggacatcaaacgaactgtggctgcaccatctgt

SEQ ID NO: 577673 - DNA, 511 bp, Homo sapiens
  misc_feature: HIJSMM301C6IZU.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacacaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcta

SEQ ID NO: 577674 - DNA, 454 bp, Homo sapiens; identical to SEQ ID NO: 536449
  misc_feature: HIJSMM301ELO14.18.78.H01.1.454.light.4.raw

SEQ ID NO: 577675 - DNA, 522 bp, Homo sapiens
  misc_feature: HIJSMM301ECG5J.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccgaacggaccgaacggtaggaaggtacgaaacgaacgtacgtaggctggcaccaatctgtcttctactcttcccgtccact

SEQ ID NO: 577676 - DNA, 502 bp, Homo sapiens
  misc_feature: HIJSMM301EMG9D.48.62.F07.1.454.light.4.raw
agtatacatacacgaccggtgctcgatttagtagtcgcataaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaaacgaactgtggctgcacc

SEQ ID NO: 577677 - DNA, 503 bp, Homo sapiens
  misc_feature: HIJSMM301EK736.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatggacaatctgagcggttgggtgttcggcggagggaccaaactgaccgtcctaggtcagcccaa

SEQ ID NO: 577678 - DNA, 510 bp, Homo sapiens
  misc_feature: HIJSMM301ANS9I.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctgcctccgtgtctggatcatctggacagtcgatcagcatttcctgcactgggaccaacagtgacattgggtcttttgactctgtctcctggtaccaacaacacccaggccaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggtttcggcggaggcaccgaagtgaccgtcctcggtcagcccaaggctcgccccctcggtcactctgttcccgccctcctcacgcgtatgt

SEQ ID NO: 577679 - DNA, 440 bp, Homo sapiens
  misc_feature: HIJSMM301DFTTU.18.9.A09.1.454.light.4.raw
tacgagtatgcacgaccggtgctcgatttagcgagacgcgcagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcactctgttcccgccctcctccatactcgta

SEQ ID NO: 577680 - DNA, 487 bp, Homo sapiens
  misc_feature: HIJSMM301B88V7.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgctagtttattactgtcagcactataataactggcctccgtacagttttggccaggggaccaagctggagatcaaacgaactgtgg

SEQ ID NO: 577681 - DNA, 478 bp, Homo sapiens; identical to SEQ ID NO: 541928
  misc_feature: HIJSMM301B6QNH.7.76.G10.1.454.light.4.raw

SEQ ID NO: 577682 - DNA, 507 bp, Homo sapiens; identical to SEQ ID NO: 542586
  misc_feature: HIJSMM301CF3GU.8.33.C11.1.454.light.4.raw

SEQ ID NO: 577683 - DNA, 491 bp, Homo sapiens; identical to SEQ ID NO: 543372
  misc_feature: HIJSMM301E084P.47.55.E11.1.454.light.4.raw

SEQ ID NO: 577684 - DNA, 501 bp, Homo sapiens
  misc_feature: HIJSMM301AYU27.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggccaacccccactgtca

SEQ ID NO: 577685 - DNA, 519 bp, Homo sapiens
  misc_feature: HIJSMM301D7EU3.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggaccgttcggccaagggaccaaggtggcaatcaaccgaactgtggctgcaccatctgtcttcatcttccccg

SEQ ID NO: 577686 - DNA, 489 bp, Homo sapiens
  misc_feature: HIJSMM301BK3GQ.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcaggggacagattttacactgaaaatcagccgggtggaggctgaggacgttggaatttattactgtatgcaaggtatagagcttcctccgacgttcggccaagggaccaaggtggaacgtcaaacgaa

SEQ ID NO: 577687 - DNA, 454 bp, Homo sapiens; identical to SEQ ID NO: 534964
  misc_feature: HIJSMM301C3S5R.19.86.H09.1.454.light.4.raw

SEQ ID NO: 577688 - DNA, 510 bp, Homo sapiens
  misc_feature: HIJSMM301BMYMO.52.38.D05.1.454.light.4.raw
  modified_base (438)..(438): a, c, t, g, unknown or other
cgcagtacgacacgaccggtgctcgatttagtatctgatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggcctcaggggtccctgatcgcttctctggctcgaagtctggcaacacggcctccctgaccgtctctgggctccaggctgaggatgaggctgattactactgcacctcatatgcaggcganaacaatttgggggtttcgcggagggaccaaggtgaccgtctacgtcagcccaaggctgccccctggtcactc

SEQ ID NO: 577689 - DNA, 444 bp, Homo sapiens; identical to SEQ ID NO: 535027
  misc_feature: HIJSMM301CWEWX.8.73.G07.1.454.light.4.raw

SEQ ID NO: 577690 - DNA, 478 bp, Homo sapiens
  misc_feature: HIJSMM301DH4EQ.5.28.C06.1.454.light.4.raw
atcagacacgcacgaccggtgctcgatttagagctcacgtattgggtttgggggtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtcccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgcaccta

SEQ ID NO: 577691 - DNA, 518 bp, Homo sapiens; identical to SEQ ID NO: 539372
  misc_feature: HIJSMM301ELWI5.7.86.H09.1.454.light.4.raw

SEQ ID NO: 577692 - DNA, 417 bp, Homo sapiens
  misc_feature: HIJSMM301CEQCW.41.53.E09.1.454.light.4.raw
tctatactatcacgaccggtgctcgatttagagagagtgtgttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtctaggtcagcccaaggctgcccctcggtcactctgttcccaccctcctcatagtataga

SEQ ID NO: 577693 - DNA, 492 bp, Homo sapiens; identical to SEQ ID NO: 570996
  misc_feature: HIJSMM301DCLWH.51.82.H05.1.454.light.4.raw

SEQ ID NO: 577694 - DNA, 505 bp, Homo sapiens; identical to SEQ ID NO: 535987
  misc_feature: HIJSMM301EFELO.18.37.D04.1.454.light.4.raw

SEQ ID NO: 577695 - DNA, 488 bp, Homo sapiens; identical to SEQ ID NO: 543022
  misc_feature: HIJSMM301C1YIN.9.59.F04.1.454.light.4.raw

SEQ ID NO: 577696 - DNA, 488 bp, Homo sapiens
  misc_feature: HIJSMM301BZZ9Q.51.40.D07.1.454.light.4.raw
cgatcgtatacacgaccggtgctcgatttagtgatagagcgtaacaacagaggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacaggggtcccatcaaggttcagtggaagtggttctgggacagattttactttcaccatcagcagccttcaccctgaagatcttgcaacatattactgtcaacagtatgataatctcccactcactttcggtcggagggaccgaaggtggaggatacaaacgaactagtggccgtgcaccat

SEQ ID NO: 577697 - DNA, 514 bp, Homo sapiens
  misc_feature: HIJSMM301BQHV6.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagcccaaggcc

SEQ ID NO: 577698 - DNA, 448 bp, Homo sapiens
  misc_feature: HIJSMM301EM267.18.9.A09.1.454.light.4.raw
  modified_base (412)..(412): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccccnctgtcactctgttccccaccctcctccatactcgta

SEQ ID NO: 577699 - DNA, 511 bp, Homo sapiens
  misc_feature: HIJSMM301BNFR5.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgcccctcggtcactctgtcccgcctcct

SEQ ID NO: 577700 - DNA, 383 bp, Homo sapiens; identical to SEQ ID NO: 447524
  misc_feature: HIJSMM301A8FIX.41.26.C04.1.454.light.4.raw

SEQ ID NO: 577701 - DNA, 511 bp, Homo sapiens
  misc_feature: HIJSMM301ET2BG.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattagagatcaaacgaactagtggctgcaccatctgtcttctatcttcccg

SEQ ID NO: 577702 - DNA, 518 bp, Homo sapiens; identical to SEQ ID NO: 535407
  misc_feature: HIJSMM301AZ61T.22.30.C08.1.454.light.4.raw

SEQ ID NO: 577703 - DNA, 515 bp, Homo sapiens
  misc_feature: HIJSMM301AFHIV.43.39.D06.1.454.light.4.raw
tgtgagtagtcacgaccggtgctcgatttagtgacatctcgcagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaagggaccaaggtggaattcaaccgaacctagtggctgcaccatctgtcttcactcttccccg

SEQ ID NO: 577704 - DNA, 500 bp, Homo sapiens
  misc_feature: HIJSMM301AUPET.48.34.D01.1.454.light.4.raw
agtatacatacacgaccggtgctcgatttagatcgtctgtgttgggtttgggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 577705 - DNA, 447 bp, Homo sapiens; identical to SEQ ID NO: 535020
  misc_feature: HIJSMM301BIIZT.18.9.A09.1.454.light.4.raw

SEQ ID NO: 577706 - DNA, 492 bp, Homo sapiens; identical to SEQ ID NO: 535426
  misc_feature: HIJSMM301E31AF.47.78.H01.1.454.light.4.raw

SEQ ID NO: 577707 - DNA, 454 bp, Homo sapiens; identical to SEQ ID NO: 534964
  misc_feature: HIJSMM301DHYRR.19.86.H09.1.454.light.4.raw

SEQ ID NO: 577708 - DNA, 491 bp, Homo sapiens; identical to SEQ ID NO: 542267
  misc_feature: HIJSMM301BZJB7.17.21.B10.1.454.light.4.raw

SEQ ID NO: 577709 - DNA, 497 bp, Homo sapiens; identical to SEQ ID NO: 535286
  misc_feature: HIJSMM301AT0WA.18.59.F04.1.454.light.4.raw

SEQ ID NO: 577710 - DNA, 454 bp, Homo sapiens; identical to SEQ ID NO: 535005
  misc_feature: HIJSMM301AM4JJ.19.86.H09.1.454.light.4.raw

SEQ ID NO: 577711 - DNA, 444 bp, Homo sapiens; identical to SEQ ID NO: 535192
  misc_feature: HIJSMM301CTQ61.5.9.A09.1.454.light.4.raw

SEQ ID NO: 577712 - DNA, 518 bp, Homo sapiens
  misc_feature: HIJSMM301CA92Z.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagccaaggctgccccctcggtcatctgttcccacct

SEQ ID NO: 577713 - DNA, 493 bp, Homo sapiens
  misc_feature: HIJSMM301BO82X.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaaacgaactgtgg

SEQ ID NO: 577714 - DNA, 482 bp, Homo sapiens
  misc_feature: HIJSMM301BJ7ZL.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcaggccattgacaaatatgtaaattggtatcaacagaagccaggtgaagcccctaagctcctgatctatactgcatccactttgtcaggcgggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcaccatctgtt

SEQ ID NO: 577715 - DNA, 493 bp, Homo sapiens
  misc_feature: HIJSMM301B5R3X.4.33.C11.1.454.light.4.raw
agcactgtagcacgaccggtgctcgatttagagtgagctcggttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccaaggtggagatcaaacgaactacgg

SEQ ID NO: 577716 - DNA, 506 bp, Homo sapiens; identical to SEQ ID NO: 534969
  misc_feature: HIJSMM301CXJ0F.18.37.D04.1.454.light.4.raw

SEQ ID NO: 577717 - DNA, 505 bp, Homo sapiens; identical to SEQ ID NO: 543569
  misc_feature: HIJSMM301AYM34.10.12.B01.1.454.light.4.raw

SEQ ID NO: 577718 - DNA, 484 bp, Homo sapiens; identical to SEQ ID NO: 535441
  misc_feature: HIJSMM301D5627.26.60.F05.1.454.light.4.raw

SEQ ID NO: 577719 - DNA, 495 bp, Homo sapiens; identical to SEQ ID NO: 564072
  misc_feature: HIJSMM301BLBA6.11.81.H04.1.454.light.4.raw

SEQ ID NO: 577720 - DNA, 502 bp, Homo sapiens; identical to SEQ ID NO: 536253
  misc_feature: HIJSMM301CWITG.21.22.B11.1.454.light.4.raw

SEQ ID NO: 577721 - DNA, 489 bp, Homo sapiens
  misc_feature: HIJSMM301C1ISH.51.64.F09.1.454.light.4.raw
  modified_base (462)..(462): a, c, t, g, unknown or other
  modified_base (464)..(464): a, c, t, g, unknown or other
  modified_base (469)..(469): a, c, t, g, unknown or other
  modified_base (483)..(483): a, c, t, g, unknown or other
  modified_base (486)..(486): a, c, t, g, unknown or other
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggtctcccaggctcctcatctatggttcatccaccagggccgctgatatcccagccaggttcagtggcagtgggtctgggacagaattcactctcaccatcagcagcctgcagtctgaagtattttgctagtttattactgtcagcagtaatgtataagtggccgtccgtactacttcgttcggacggacggacgcgngngaganaacaacgagtgtgnacncac

SEQ ID NO: 577722 - DNA, 496 bp, Homo sapiens; identical to SEQ ID NO: 535109
  misc_feature: HIJSMM301A21YR.16.78.H01.1.454.light.4.raw

SEQ ID NO: 577723 - DNA, 496 bp, Homo sapiens; identical to SEQ ID NO: 562690
  misc_feature: HIJSMM301BA32E.51.5.A05.1.454.light.4.raw

SEQ ID NO: 577724 - DNA, 504 bp, Homo sapiens
  misc_feature: HIJSMM301CZ0EA.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggccaagctgaccgtcctaggtcagcccaaggctgcccctcggt

SEQ ID NO: 577725 - DNA, 510 bp, Homo sapiens; identical to SEQ ID NO: 553863
  misc_feature: HIJSMM301BY8F8.16.46.E02.1.454.light.4.raw

SEQ ID NO: 577726 - DNA, 503 bp, Homo sapiens
  misc_feature: HIJSMM301C4VVE.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggcctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtctacc

SEQ ID NO: 577727 - DNA, 494 bp, Homo sapiens; identical to SEQ ID NO: 535090
  misc_feature: HIJSMM301CB9FO.27.78.H01.1.454.light.4.raw
  modified_base (403)..(403): a, c, t, g, unknown or other

SEQ ID NO: 577728 - DNA, 488 bp, Homo sapiens
  misc_feature: HIJSMM301BIEI8.49.38.D05.1.454.light.4.raw
agtcgagagacacgaccggtgctcgatttagtatctgatagttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggtagggaccaagctgaccgtcctaggtcagcccaaggctccg

SEQ ID NO: 577729 - DNA, 518 bp, Homo sapiens
  misc_feature: HIJSMM301BKK1D.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattactgccaggcgtgggacagctccacttcccgttatgtcttcggaggtgggaccatggtcaccgtcctaggtcagcccaagaccaaccccactgtcactctgttcccgccctcctctacgtcg

SEQ ID NO: 577730 - DNA, 488 bp, Homo sapiens
  misc_feature: HIJSMM301COBQ1.19.71.G05.1.454.light.4.raw
  modified_base (473)..(473): a, c, t, g, unknown or other
tactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggatagcctcctaggctgctcatttactgggcatctaccagggaatccggggtccctgaccgattcagtggcagcgggtctgggacagatttcactctcaccatcagcagcctgcaggctgaagatgtggcagtttatattgtcaacaatattattatacttcgtggacgtcgtccaggaccgaacgtaggagtatnagacgaacagtgcgt

SEQ ID NO: 577731 - DNA, 493 bp, Homo sapiens
  misc_feature: HIJSMM301CYV7Z.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctcgaggctcactttcggcggagggaccaaggtggagatcaaacgaact

SEQ ID NO: 577732 - DNA, 496 bp, Homo sapiens
  misc_feature: HIJSMM301BJC8V.21.47.E03.1.454.light.4.raw
tcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttagcctggtatcagcagaaaccaggaaaagcccctaaactcctgatctatgctgcatccacgttgcaaagtggagtcccgtcaaggttcagcggcaggtgggtctgggacggatttcaatctcaccatcaccagcctgcagcctgaagattttgctaacttattattgtcaacaggactaactagttttcctctcacgttcggcggaggaccaacgtggaggtcaaacgaactgtggctgcaccatctgtt

SEQ ID NO: 577733 - DNA, 489 bp, Homo sapiens; identical to SEQ ID NO: 535139
  misc_feature: HIJSMM301DA6GJ.14.55.E11.1.454.light.4.raw

SEQ ID NO: 577734 - DNA, 494 bp, Homo sapiens; identical to SEQ ID NO: 534992
  misc_feature: HIJSMM301DKPZN.9.1.A01.1.454.light.4.raw

SEQ ID NO: 577735 - DNA, 515 bp, Homo sapiens
  misc_feature: HIJSMM301AOARI.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcctaggtcagcccaaggctgccccctcggtcactctcgttcccaccctcct

SEQ ID NO: 577736 - DNA, 491 bp, Homo sapiens; identical to SEQ ID NO: 572738
  misc_feature: HIJSMM301EOYE1.16.68.G02.1.454.light.4.raw

SEQ ID NO: 577737 - DNA, 505 bp, Homo sapiens; identical to SEQ ID NO: 549086
  misc_feature: HIJSMM301DPSB2.10.71.G05.1.454.light.4.raw

SEQ ID NO: 577738 - DNA, 342 bp, Homo sapiens
  misc_feature: HIJSMM301C1D49.52.74.G08.1.454.light.4.raw
cgcagtacgacacgaccggtgctcgatttagtagctctatcagggattgtgaccagacatgtgcactggtatcagcagaagccaggccaggcccctgtcctggtcatctatagggatattaagcggccctctggaatccctgagcgattcactggcgccaattcggcaaacacggccaccctgaccatcagtgaagcccaagtcggggatgaggctgactactcgtgtcaggtgtgggacagcggcactatgattttcggcggagggaccaagttgaccgtcctaagtcagcccaaggctgccccctcggtcactctgttcccgccctcctctatacgatcg

SEQ ID NO: 577739 - DNA, 486 bp, Homo sapiens
  misc_feature: HIJSMM301BT2L2.49.61.F06.1.454.light.4.raw
agtcgagagacacgaccggtgctcgatttagctacgctctaagggaaagggggaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatggagcattcgtgcgctcaccttcggcggagggaccaaggtcggagatcaaacgaactgtggctgcacc

SEQ ID NO: 577740 - DNA, 512 bp, Homo sapiens
  misc_feature: HIJSMM301D0BDB.9.12.B01.1.454.light.4.raw
  modified_base (497)..(497): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgtccaaggaccaaggtaggaaagtacaaacgaaactagtaggctggcaccaactctcgtnttcctatcttccccg

SEQ ID NO: 577741 - DNA, 488 bp, Homo sapiens
  misc_feature: HIJSMM301BVNLV.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacaggagttcactctcaccatcagcagcctgcagtctgaggattttgcagtttattactgtcagcattacaataactggcctcggctcactttcggcggagggaccaaggtggagatacaaacgaactgtggctgcaccat

SEQ ID NO: 577742 - DNA, 481 bp, Homo sapiens
  misc_feature: HIJSMM301BK3D8.51.83.H06.1.454.light.4.raw
cgatcgtatacacgaccggtgctcgatttagatcacgtgcgtcgcggggagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagttttattattgtcagcagcgaaacaactggcctccttggacgttcggccaagggaccaaggtggaaatcaaacgaactgtggctgcaccatctgtcttcatcttccgccat

SEQ ID NO: 577743 - DNA, 494 bp, Homo sapiens; identical to SEQ ID NO: 559643
  misc_feature: HIJSMM301CYKG4.27.78.H01.1.454.light.4.raw

SEQ ID NO: 577744 - DNA, 489 bp, Homo sapiens; identical to SEQ ID NO: 535091
  misc_feature: HIJSMM301BD974.47.36.D03.1.454.light.4.raw

SEQ ID NO: 577745 - DNA, 506 bp, Homo sapiens
  misc_feature: HIJSMM301DUVQJ.21.22.B11.1.454.light.4.raw
  modified_base (463)..(463): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatccagtgggctccggtccgaggatgaggcttgactattactgtgcatcacgggacgcaacatgggatgacaatctgagcggttgggtnttcgggcggagggaccaaactgaccgtcctaggtcagccccaa

SEQ ID NO: 577746 - DNA, 482 bp, Homo sapiens; identical to SEQ ID NO: 536622
  misc_feature: HIJSMM301AHOXZ.7.85.H08.1.454.light.4.raw

SEQ ID NO: 577747 - DNA, 493 bp, Homo sapiens; identical to SEQ ID NO: 535047
  misc_feature: HIJSMM301AIJIT.16.53.E09.1.454.light.4.raw

SEQ ID NO: 577748 - DNA, 485 bp, Homo sapiens
  misc_feature: HIJSMM301ATPJE.40.83.H06.1.454.light.4.raw
tctagcgactcacgaccggtgctcgatttagatcacgtgcgtcgcgggtctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtggttcggcggagggaccaaactgtccgtcctaggtcacg

SEQ ID NO: 577749 - DNA, 496 bp, Homo sapiens; identical to SEQ ID NO: 567336
  misc_feature: HIJSMM301DP4MG.11.81.H04.1.454.light.4.raw

SEQ ID NO: 577750 - DNA, 454 bp, Homo sapiens; identical to SEQ ID NO: 535005
  misc_feature: HIJSMM301DE94F.19.86.H09.1.454.light.4.raw

SEQ ID NO: 577751 - DNA, 492 bp, Homo sapiens
  misc_feature: HIJSMM301EU2MN.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtgggaggctgaggatgttattgggctctattattgcatgcaagcaacacactggccgtacacttttggccaggggaccaagctggaggatcaatcgaactgt

SEQ ID NO: 577752 - DNA, 486 bp, Homo sapiens; identical to SEQ ID NO: 566033
  misc_feature: HIJSMM301BHZ8O.26.37.D04.1.454.light.4.raw

SEQ ID NO: 577753 - DNA, 506 bp, Homo sapiens
  misc_feature: HIJSMM301CUNHA.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtggaaagtcaaacgaaactgtaggctgcaccatctgtcttcatcttccccg

SEQ ID NO: 577754 - DNA, 510 bp, Homo sapiens; identical to SEQ ID NO: 563279
  misc_feature: HIJSMM301DEJTP.48.56.F01.1.454.light.4.raw

SEQ ID NO: 577755 - DNA, 499 bp, Homo sapiens; identical to SEQ ID NO: 560695
  misc_feature: HIJSMM301CZAIP.2.34.D01.1.454.light.4.raw

SEQ ID NO: 577756 - DNA, 488 bp, Homo sapiens; identical to SEQ ID NO: 536554
  misc_feature: HIJSMM301AQ0HJ.26.37.D04.1.454.light.4.raw

SEQ ID NO: 577757 - DNA, 491 bp, Homo sapiens; identical to SEQ ID NO: 544714
  misc_feature: HIJSMM301CIBE0.18.11.A11.1.454.light.4.raw

SEQ ID NO: 577758 - DNA, 377 bp, Homo sapiens; identical to SEQ ID NO: 536071
  misc_feature: HIJSMM301DRZHW.40.9.A09.1.454.light.4.raw

SEQ ID NO: 577759 - DNA, 486 bp, Homo sapiens
  misc_feature: HIJSMM301BVP94.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgttcagacctatagtggtggcccgctcattttcggcggagggaccaaggtgcagatcaaacgaactgtggctgcaa

SEQ ID NO: 577760 - DNA, 469 bp, Homo sapiens
  misc_feature: HIJSMM301BBYXA.49.37.D04.1.454.light.4.raw
agtcgagagacacgaccggtgctcgatttagtagcatactgttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggccaggggaccaggctggatatcagacgaa

SEQ ID NO: 577761 - DNA, 510 bp, Homo sapiens
  misc_feature: HIJSMM301EVH0Z.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggccctcgggaccaaagtaggatatacaaacgaactagtggctgcaccatctgtctt

SEQ ID NO: 577762 - DNA, 503 bp, Homo sapiens; identical to SEQ ID NO: 540136
  misc_feature: HIJSMM301EK1RF.19.10.A10.1.454.light.4.raw

SEQ ID NO: 577763 - DNA, 488 bp, Homo sapiens
  misc_feature: HIJSMM301AMVX1.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccacggacagacggccaagatcacctgctctggagatgcattgccaaagcaatatgcttattggtaccaacaaaagaccaggccaggcccctcgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaa

SEQ ID NO: 577764 - DNA, 503 bp, Homo sapiens; identical to SEQ ID NO: 548067
  misc_feature: HIJSMM301EDYJT.9.53.E09.1.454.light.4.raw

SEQ ID NO: 577765 - DNA, 444 bp, Homo sapiens; identical to SEQ ID NO: 550016
  misc_feature: HIJSMM301B3AC9.14.76.G10.1.454.light.4.raw

SEQ ID NO: 577766 - DNA, 492 bp, Homo sapiens; identical to SEQ ID NO: 537395
  misc_feature: HIJSMM301CIRU9.16.73.G07.1.454.light.4.raw

SEQ ID NO: 577767 - DNA, 505 bp, Homo sapiens; identical to SEQ ID NO: 536254
  misc_feature: HIJSMM301D6JMD.7.71.G05.1.454.light.4.raw

SEQ ID NO: 577768 - DNA, 494 bp, Homo sapiens; identical to SEQ ID NO: 534992
  misc_feature: HIJSMM301BLDPE.9.1.A01.1.454.light.4.raw

SEQ ID NO: 577769 - DNA, 460 bp, Homo sapiens; identical to SEQ ID NO: 537107
  misc_feature: HIJSMM301AL3S2.22.28.C06.1.454.light.4.raw

SEQ ID NO: 577770 - DNA, 487 bp, Homo sapiens; identical to SEQ ID NO: 549731
  misc_feature: HIJSMM301AOJE0.8.12.B01.1.454.light.4.raw

SEQ ID NO: 577771 - DNA, 492 bp, Homo sapiens; identical to SEQ ID NO: 543452
  misc_feature: HIJSMM301EAW4X.3.72.G06.1.454.light.4.raw

SEQ ID NO: 577772 - DNA, 472 bp, Homo sapiens; identical to SEQ ID NO: 536302
  misc_feature: HIJSMM301AH7R8.18.76.G10.1.454.light.4.raw

SEQ ID NO: 577773 - DNA, 501 bp, Homo sapiens
  misc_feature: HIJSMM301DA8I1.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcgtcggacggggacgaacggtagggtagagtctaaacgaacgtaacg

SEQ ID NO: 577774 - DNA, 503 bp, Homo sapiens
  misc_feature: HIJSMM301C6FA1.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgatttatttctgcggctcatatggagacaattacagctttgtcttcggaagtgggaccaaggtcaccgtcctaagtcagcccaaggcccaacccactgtcactctgttcacgt

SEQ ID NO: 577775 - DNA, 501 bp, Homo sapiens
  misc_feature: HIJSMM301DY382.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccagcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 577776 - DNA, 485 bp, Homo sapiens
  misc_feature: HIJSMM301BW9T5.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccgacggtggagatcaaacgaactgtggctgcaccatctgt

SEQ ID NO: 577777 - DNA, 516 bp, Homo sapiens
  misc_feature: HIJSMM301ET974.40.87.H10.1.454.light.4.raw
tctagcgactcacgaccggtgctcgatttagcagtactgcgttgggtttggggcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcgggcggagggaccaagctgaccgtcctaggtcagcccaaggctgccccctcggtca

SEQ ID NO: 577778 - DNA, 502 bp, Homo sapiens; identical to SEQ ID NO: 542554
  misc_feature: HIJSMM301D7P8N.48.67.G01.1.454.light.4.raw

SEQ ID NO: 577779 - DNA, 441 bp, Homo sapiens
  misc_feature: HIJSMM301CLOJQ.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgcccttctcgtatctctcg

SEQ ID NO: 577780 - DNA, 506 bp, Homo sapiens; identical to SEQ ID NO: 534969
  misc_feature: HIJSMM301A8WVY.18.37.D04.1.454.light.4.raw

SEQ ID NO: 577781 - DNA, 513 bp, Homo sapiens; identical to SEQ ID NO: 535244
  misc_feature: HIJSMM301BQ8WJ.17.33.C11.1.454.light.4.raw

SEQ ID NO: 577782 - DNA, 505 bp, Homo sapiens; identical to SEQ ID NO: 546460
  misc_feature: HIJSMM301A5HPX.15.5.A05.1.454.light.4.raw

SEQ ID NO: 577783 - DNA, 522 bp, Homo sapiens
  misc_feature: HIJSMM301A8XM5.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcaatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccaagtgacacttgggtgttcggcggagggaccaggctgaccgtcctaggtcagcccaaggctgccccctcggtcactctgttcccaccct

SEQ ID NO: 577784 - DNA, 483 bp, Homo sapiens
  misc_feature: HIJSMM301BMDGZ.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggatatcagacgaa

SEQ ID NO: 577785 - DNA, 521 bp, Homo sapiens; identical to SEQ ID NO: 539470
  misc_feature: HIJSMM301EQOW1.27.23.C01.1.454.light.4.raw

SEQ ID NO: 577786 - DNA, 520 bp, Homo sapiens
  misc_feature: HIJSMM301DJ3YI.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctgttcccacct

SEQ ID NO: 577787 - DNA, 495 bp, Homo sapiens; identical to SEQ ID NO: 535007
  misc_feature: HIJSMM301EPMWP.22.5.A05.1.454.light.4.raw

SEQ ID NO: 577788 - DNA, 503 bp, Homo sapiens; identical to SEQ ID NO: 557750
  misc_feature: HIJSMM301C4OAF.8.71.G05.1.454.light.4.raw

SEQ ID NO: 577789 - DNA, 494 bp, Homo sapiens
  misc_feature: HIJSMM301AGMU9.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacgcagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagccaaggccaaccccactgtcact

SEQ ID NO: 577790 - DNA, 484 bp, Homo sapiens
  misc_feature: HIJSMM301DAWA9.43.36.D03.1.454.light.4.raw
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctctttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 577791 - DNA, 508 bp, Homo sapiens; identical to SEQ ID NO: 537871
  misc_feature: HIJSMM301ETCR3.8.33.C11.1.454.light.4.raw

SEQ ID NO: 577792 - DNA, 494 bp, Homo sapiens
  misc_feature: HIJSMM301EJ63H.51.66.F11.1.454.light.4.raw
cgatcgtatacacgaccggtgctcgatttagtcacgcgagaaaggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaatgctgtaaactggtaccagcagctcccaggaacggcccccaaactcctcatctacagtagtaatcagcggccctcaggggtccctgaccgattctctggctccaagtctggtcacctcagcctccctggccatcagtgggctccagtctgaggatgaggcttattattactgtgcagcatgggatgacagcctgagtgctcatgtggtattcggcggagggaccaagctgaccgtcctaggtcagccccg

SEQ ID NO: 577793 - DNA, 494 bp, Homo sapiens
  misc_feature: HIJSMM301A9V3S.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttacttggcctctacccgggaatccggggtctctggccgattcagtgccagcgggtctgggacagagttcactctcaccatcagcagcctgcaggctgaagatgtggcagttattactgtcagcaatattttcgtgctccgtacacttttggccaggggacccaggtggagatcagacgaactgtggctgcaccatctgtcttcatcttcccg

SEQ ID NO: 577794 - DNA, 501 bp, Homo sapiens; identical to SEQ ID NO: 538431
  misc_feature: HIJSMM301C4SZ3.21.22.B11.1.454.light.4.raw

SEQ ID NO: 577795 - DNA, 500 bp, Homo sapiens
  misc_feature: HIJSMM301B24PZ.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaaccctac

SEQ ID NO: 577796 - DNA, 483 bp, Homo sapiens
  misc_feature: HIJSMM301BYS3L.48.27.C05.1.454.light.4.raw
agtatacatacacgaccggtgctcgatttagacgcgatcgaagggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggccaagggaccaaggtggaagtacaaacgaactagtggctgcacc

SEQ ID NO: 577797 - DNA, 519 bp, Homo sapiens
  misc_feature: HIJSMM301BPU9C.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcgtcactctgtcccgccct

SEQ ID NO: 577798 - DNA, 497 bp, Homo sapiens
  misc_feature: HIJSMM301ANJQO.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtccctcaaggttcagtggcagtggatctgggacagactttactctcaccatcagcgatctgcagcctgacgattttgcgacttactactgtcaacagagtttccggaacccgttactttcggcggagggaccaaggtggaggatcaacgaactgtggctgcaccatctgtcttcatcttccccg

SEQ ID NO: 577799 - DNA, 494 bp, Homo sapiens; identical to SEQ ID NO: 534992
  misc_feature: HIJSMM301EDGVP.9.1.A01.1.454.light.4.raw

SEQ ID NO: 577800 - DNA, 487 bp, Homo sapiens; identical to SEQ ID NO: 538190
  misc_feature: HIJSMM301B0GGP.47.70.G04.1.454.light.4.raw

SEQ ID NO: 577801 - DNA, 486 bp, Homo sapiens; identical to SEQ ID NO: 535385
  misc_feature: HIJSMM301AI0W9.19.71.G05.1.454.light.4.raw

SEQ ID NO: 577802 - DNA, 511 bp, Homo sapiens
  misc_feature: HIJSMM301BGUVE.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcgaggaccgaacggtaggaagtacaagacgaactacgtggcgtggcaccactctgtcttctatcttcttccg

SEQ ID NO: 577803 - DNA, 503 bp, Homo sapiens
  misc_feature: HIJSMM301A4M6Y.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtca

SEQ ID NO: 577804 - DNA, 504 bp, Homo sapiens
  misc_feature: HIJSMM301EMKEL.13.36.D03.1.454.light.4.raw
tcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagtgtcaccatctcttgttctggaggcagtgccaacatcgggagtaattatgcattctggtatcaacaactcccaggaacggcccccagactcctcatctatagcaataaccagcggccctcaggggtccctgaccgattctctggctccaagtctggcacctcagcctccctggccatcagtgggctccggtccgacgatgaggctgattattactgttcagcttgggatgacagcctgaatacttgggttttcggcggagggaccaagttgaccgtcctaggtcagccaaggctccg

SEQ ID NO: 577805 - DNA, 496 bp, Homo sapiens
  misc_feature: HIJSMM301A23RB.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctccggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 577806 - DNA, 491 bp, Homo sapiens
  misc_feature: HIJSMM301CFGWN.51.39.D06.1.454.light.4.raw
cgatcgtatacacgaccggtgctcgatttagtgacatctcgcagttctttgggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactggaccaaggtcaccgtctaggtcagcccaaggccaacccact

SEQ ID NO: 577807 - DNA, 491 bp, Homo sapiens
  misc_feature: HIJSMM301B8LYL.48.27.C05.1.454.light.4.raw
agtatacatacacgaccggtgctcgatttagacgcgatcgaagggtttggggagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccgaaggtggaggatcaaacgaactagtggctgcacca

SEQ ID NO: 577808 - DNA, 486 bp, Homo sapiens
  misc_feature: HIJSMM301DNFMU.46.35.D02.1.454.light.4.raw
actagcagtacacgaccggtgctcgatttagcacacgatagttgggtttgggggacgctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgcaccat

SEQ ID NO: 577809 - DNA, 502 bp, Homo sapiens
  misc_feature: HIJSMM301CP0RD.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgatttttactgcggaacatgggataccaggctgcatggtgtggttttcggcggagggaccaagctgaccgtctaagtcagcccaaggctgccccc

SEQ ID NO: 577810 - DNA, 546 bp, Homo sapiens
  misc_feature: HIJSMM301AGB7H.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgtcagtttattactgtcaacagcgtagcagcaggccgtcccggcggacgttcggtccgaacgggaaccgaacggtagggaaggtacgtaacgacgaacgtacgtgggtcgtgtcaccgaactcttcgttcttctactcttccccgtcccact

SEQ ID NO: 577811 - DNA, 499 bp, Homo sapiens
  misc_feature: HIJSMM301ASBKO.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctacttctgtcggagacagagtcaccatcacttgccaggcgagtgaggacattcggaaatttttaaatttggtttcagcagaaaccagggaaagccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttcatt

SEQ ID NO: 577812 - DNA, 512 bp, Homo sapiens
  misc_feature: HIJSMM301C6ZH9.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccacctcctcga

SEQ ID NO: 577813 - DNA, 485 bp, Homo sapiens; identical to SEQ ID NO: 536075
  misc_feature: HIJSMM301AUQEN.17.21.B10.1.454.light.4.raw

SEQ ID NO: 577814 - DNA, 483 bp, Homo sapiens; identical to SEQ ID NO: 536202
  misc_feature: HIJSMM301EB1MG.43.24.C02.1.454.light.4.raw

SEQ ID NO: 577815 - DNA, 515 bp, Homo sapiens
  misc_feature: HIJSMM301CW4IX.12.85.H08.1.454.light.4.raw
atacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtggaccaagctgaccgtcctaagtcagcccaaggcctgccccctcggtcactctgttccca

SEQ ID NO: 577816 - DNA, 497 bp, Homo sapiens; identical to SEQ ID NO: 535286
  misc_feature: HIJSMM301EN89D.18.59.F04.1.454.light.4.raw

SEQ ID NO: 577817 - DNA, 515 bp, Homo sapiens; identical to SEQ ID NO: 541619
  misc_feature: HIJSMM301EM11J.10.86.H09.1.454.light.4.raw

SEQ ID NO: 577818 - DNA, 489 bp, Homo sapiens; identical to SEQ ID NO: 558034
  misc_feature: HIJSMM301EAZZ5.8.12.B01.1.454.light.4.raw

SEQ ID NO: 577819 - DNA, 503 bp, Homo sapiens
  misc_feature: HIJSMM301D43O3.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagcccaaggcc

SEQ ID NO: 577820 - DNA, 485 bp, Homo sapiens; identical to SEQ ID NO: 544293
  misc_feature: HIJSMM301BDKGV.26.70.G04.1.454.light.4.raw

SEQ ID NO: 577821 - DNA, 478 bp, Homo sapiens
  misc_feature: HIJSMM301A429T.4.10.A10.1.454.light.4.raw
agcactgtagcacgaccggtgctcgatttagcgtcgatctcagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcggagggaccaaggtggagatcaaacgaactagtggctgcaccat

SEQ ID NO: 577822 - DNA, 494 bp, Homo sapiens; identical to SEQ ID NO: 541400
  misc_feature: HIJSMM301ESAWL.51.71.G05.1.454.light.4.raw

SEQ ID NO: 577823 - DNA, 488 bp, Homo sapiens
  misc_feature: HIJSMM301C4O06.52.27.C05.1.454.light.4.raw
cgcagtacgacacgaccggtgctcgatttagacgcgatcgaagggtttgggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtgggtccgtcaaggttcagtggccgtggatctgggacagatttcactctcaccatcagcagtctccaacctgaagattttgcaatttactactgtcaacagagtgacaatacccctcagactttcggcctgggaccagagtggatatacaaacgaactgtggctgcaccatctgtctt

SEQ ID NO: 577824 - DNA, 496 bp, Homo sapiens; identical to SEQ ID NO: 535541
  misc_feature: HIJSMM301BT3KS.3.33.C11.1.454.light.4.raw

SEQ ID NO: 577825 - DNA, 383 bp, Homo sapiens; identical to SEQ ID NO: 447524
  misc_feature: HIJSMM301AITS4.41.26.C04.1.454.light.4.raw

SEQ ID NO: 577826 - DNA, 495 bp, Homo sapiens
  misc_feature: HIJSMM301BATPX.40.65.F10.1.454.light.4.raw
tctagcgactcacgaccggtgctcgatttagctacgctctaaggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaacgaactgtggctgcaccatctgtcttcatcttccg

SEQ ID NO: 577827 - DNA, 501 bp, Homo sapiens
  misc_feature: HIJSMM301C5RZ0.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacaccggcctccctgaccatctctgggctccaggctgaggacgaggctgattattactgcagctcatatacaagcagcagcactcaagtcttcggaactggaccaaggtccaccgtcctaggtcacgccaaggcccaaccca

SEQ ID NO: 577828 - DNA, 510 bp, Homo sapiens; identical to SEQ ID NO: 537801
  misc_feature: HIJSMM301EB1RA.5.60.F05.1.454.light.4.raw

SEQ ID NO: 577829 - DNA, 497 bp, Homo sapiens; identical to SEQ ID NO: 534982
  misc_feature: HIJSMM301EXMFJ.26.80.H03.1.454.light.4.raw

SEQ ID NO: 577830 - DNA, 485 bp, Homo sapiens
  misc_feature: HIJSMM301CME2H.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagtttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 577831 - DNA, 475 bp, Homo sapiens
  misc_feature: HIJSMM301AC8V1.49.4.A04.1.454.light.4.raw
agtcgagagacacgaccggtgctcgatttagagtagtgatcagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttctaccatcagcaggctgcagcctgaagatattgcaacatattactgtcaacagtatgatcgcctcccgctcactttacggtcgggggaccggaacggtaggagatcaagcgaactgtggc

SEQ ID NO: 577832 - DNA, 485 bp, Homo sapiens; identical to SEQ ID NO: 536040
  misc_feature: HIJSMM301CM4D9.15.1.A01.1.454.light.4.raw

SEQ ID NO: 577833 - DNA, 516 bp, Homo sapiens; identical to SEQ ID NO: 542229
  misc_feature: HIJSMM301BN90Z.3.87.H10.1.454.light.4.raw

SEQ ID NO: 577834 - DNA, 500 bp, Homo sapiens
  misc_feature: HIJSMM301C6YYI.49.24.C02.1.454.light.4.raw
agtcgagagacacgaccggtgctcgatttagtacagatcgttagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcaggcccaaggccaacccactgtcactctcg

SEQ ID NO: 577835 - DNA, 511 bp, Homo sapiens
  misc_feature: HIJSMM301EOTEQ.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaacggctgccccctccggtcacctctcgttcccaccctcctcctacgtccgtat

SEQ ID NO: 577836 - DNA, 508 bp, Homo sapiens
  misc_feature: HIJSMM301E3O8J.26.72.G06.1.454.light.4.raw
  modified_base (480)..(480): a, c, t, g, unknown or other
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccaattcagtgccagcgggtctgggacagagttcactctcaccatcagcagcctgcaggctgaagatgtggcagtttattactgtcagcaatattttcgtgctccgtacacttttggccaggggacccaggtggagatcagactgatattaacagcgaaaagngattttgtaagggaagtaatgaagttaa

SEQ ID NO: 577837 - DNA, 494 bp, Homo sapiens; identical to SEQ ID NO: 535680
  misc_feature: HIJSMM301DH2LQ.16.78.H01.1.454.light.4.raw

SEQ ID NO: 577838 - DNA, 485 bp, Homo sapiens; identical to SEQ ID NO: 536075
  misc_feature: HIJSMM301D9N9F.17.21.B10.1.454.light.4.raw

SEQ ID NO: 577839 - DNA, 514 bp, Homo sapiens; identical to SEQ ID NO: 541418
  misc_feature: HIJSMM301DLQLB.17.33.C11.1.454.light.4.raw

SEQ ID NO: 577840 - DNA, 490 bp, Homo sapiens; identical to SEQ ID NO: 541974
  misc_feature: HIJSMM301CPNK2.22.65.F10.1.454.light.4.raw

SEQ ID NO: 577841 - DNA, 487 bp, Homo sapiens
  misc_feature: HIJSMM301DHKYD.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccttcactttcggcggagggaccaaggtggagatcaagcgaactgtggctgcaccat

SEQ ID NO: 577842 - DNA, 506 bp, Homo sapiens
  misc_feature: HIJSMM301BFK41.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccgaaggtggaaatcaaacgaactagtggctgcaccatctgtcttcatcttccccg

SEQ ID NO: 577843 - DNA, 512 bp, Homo sapiens
  misc_feature: HIJSMM301B5MM7.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccactctgtcttcattctttcccg

SEQ ID NO: 577844 - DNA, 481 bp, Homo sapiens
  misc_feature: HIJSMM301CI9S2.3.38.D05.1.454.light.4.raw
  modified_base (461)..(461): a, c, t, g, unknown or other
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgctaacttactaactgtcaacagagtttcactaccctctcactttcggcgggggaccaaggtgagatnaaacgaactgtggctgcacc

SEQ ID NO: 577845 - DNA, 493 bp, Homo sapiens; identical to SEQ ID NO: 543205
  misc_feature: HIJSMM301AX8KP.51.6.A06.1.454.light.4.raw

SEQ ID NO: 577846 - DNA, 500 bp, Homo sapiens; identical to SEQ ID NO: 542309
  misc_feature: HIJSMM301BNV3Z.12.86.H09.1.454.light.4.raw

SEQ ID NO: 577847 - DNA, 497 bp, Homo sapiens
  misc_feature: HIJSMM301DNI8C.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgaccctcctcgagtgcgtct

SEQ ID NO: 577848 - DNA, 515 bp, Homo sapiens; identical to SEQ ID NO: 540368
  misc_feature: HIJSMM301BKYS1.16.88.H11.1.454.light.4.raw

SEQ ID NO: 577849 - DNA, 502 bp, Homo sapiens; identical to SEQ ID NO: 537816
  misc_feature: HIJSMM301CSD1L.19.78.H01.1.454.light.4.raw

SEQ ID NO: 577850 - DNA, 503 bp, Homo sapiens
  misc_feature: HIJSMM301A7MX4.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataattttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 577851 - DNA, 500 bp, Homo sapiens; identical to SEQ ID NO: 544063
  misc_feature: HIJSMM301AGWNO.12.18.B07.1.454.light.4.raw

SEQ ID NO: 577852 - DNA, 491 bp, Homo sapiens
  misc_feature: HIJSMM301DOLRA.48.82.H05.1.454.light.4.raw
agtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcagggtttctgatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctg

SEQ ID NO: 577853 - DNA, 497 bp, Homo sapiens
  misc_feature: HIJSMM301CRU40.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgttcggccaagggaccaaggtggacctcaaacgaacagtggctgcaccat

SEQ ID NO: 577854 - DNA, 483 bp, Homo sapiens
  misc_feature: HIJSMM301C706M.48.5.A05.1.454.light.4.raw
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccgaaggtaggaaatacaaacgaactagtggcgtgcaccat

SEQ ID NO: 577855 - DNA, 487 bp, Homo sapiens; identical to SEQ ID NO: 555321
  misc_feature: HIJSMM301A3ODT.19.71.G05.1.454.light.4.raw

SEQ ID NO: 577856 - DNA, 492 bp, Homo sapiens
  misc_feature: HIJSMM301CPRUJ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcgagggccagtcactatgttagtgacaactacttagcctggttgcagcacaacctggccaggctccaggctcctcatctatgctgcatccatcagggccactggcatcccaggcagattcagtggcagtgggtctgggacagacttcactctcaccatcagcagactggagcctgaagtattttgcagtctattactgtcagcagtatggtcacgtcccaagaacttttggccagggaccaagctggagatcaaacgaactgtggctcgcaccactcttcg

SEQ ID NO: 577857 - DNA, 486 bp, Homo sapiens; identical to SEQ ID NO: 535043
  misc_feature: HIJSMM301B6QDQ.46.35.D02.1.454.light.4.raw

SEQ ID NO: 577858 - DNA, 488 bp, Homo sapiens; identical to SEQ ID NO: 540922
  misc_feature: HIJSMM301B6MW0.14.55.E11.1.454.light.4.raw
  modified_base (427)..(427): a, c, t, g, unknown or other

SEQ ID NO: 577859 - DNA, 485 bp, Homo sapiens; identical to SEQ ID NO: 536307
  misc_feature: HIJSMM301C19NZ.46.35.D02.1.454.light.4.raw

SEQ ID NO: 577860 - DNA, 499 bp, Homo sapiens; identical to SEQ ID NO: 545768
  misc_feature: HIJSMM301D9ZKZ.52.36.D03.1.454.light.4.raw

SEQ ID NO: 577861 - DNA, 441 bp, Homo sapiens; identical to SEQ ID NO: 535074
  misc_feature: HIJSMM301CT55O.11.3.A03.1.454.light.4.raw

SEQ ID NO: 577862 - DNA, 485 bp, Homo sapiens; identical to SEQ ID NO: 536040
  misc_feature: HIJSMM301CK8N2.15.1.A01.1.454.light.4.raw

SEQ ID NO: 577863 - DNA, 494 bp, Homo sapiens; identical to SEQ ID NO: 564570
  misc_feature: HIJSMM301E01YD.51.29.C07.1.454.light.4.raw

SEQ ID NO: 577864 - DNA, 502 bp, Homo sapiens
  misc_feature: HIJSMM301D2NZM.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaactgtggctgcaccatctgtcttcat

SEQ ID NO: 577865 - DNA, 495 bp, Homo sapiens; identical to SEQ ID NO: 545773
  misc_feature: HIJSMM301COIBO.27.78.H01.1.454.light.4.raw

SEQ ID NO: 577866 - DNA, 508 bp, Homo sapiens
  misc_feature: HIJSMM301EOCC4.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttgggtccctgatcgcttctctggctccatccttgggaacaaggctgccctcaccatcacgggggcccaggcagatgatgaatctaattatcactgtgcgttgtatatgggttttggctatttcggtgttcggcggagggacccaggtgaccgtcctacgtcagccc

SEQ ID NO: 577867 - DNA, 494 bp, Homo sapiens
  misc_feature: HIJSMM301ECA2O.16.75.G09.1.454.light.4.raw
tgtactactccacgaccggtgctcgatttagtatagacatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtaggtcgttataactatgtctcctggtaccaacaacacccaggcaacgcccccaggctcatgatttatgaggtcaatgatcggccctcaggaatttccaatcgcttctctggctccaagtctggcaacacggcctccctgacaatctctgacctccagcctgaggacgaggctgaatattactgcagttcatatacaactaagagtcttgtggtattcggcggagggaccaagctgacagtcctaggtcagcccaaggctgccccctc

SEQ ID NO: 577868 - DNA, 508 bp, Homo sapiens
  misc_feature: HIJSMM301CJB2Y.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctcgggaccaaggtggagatcaaacgaactgtggctgcaccatctgtcttcta

SEQ ID NO: 577869 - DNA, 484 bp, Homo sapiens
  misc_feature: HIJSMM301D044P.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgg

SEQ ID NO: 577870 - DNA, 404 bp, Homo sapiens; identical to SEQ ID NO: 535779
  misc_feature: HIJSMM301C691J.4.35.D02.1.454.light.4.raw

SEQ ID NO: 577871 - DNA, 480 bp, Homo sapiens; identical to SEQ ID NO: 535291
  misc_feature: HIJSMM301DONEB.22.59.F04.1.454.light.4.raw

SEQ ID NO: 577872 - DNA, 495 bp, Homo sapiens
  misc_feature: HIJSMM301DW61Q.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctcctgacgttcgaccaagggaccaaggtggagatcaaacgaactgtggctgcaccat

SEQ ID NO: 577873 - DNA, 494 bp, Homo sapiens; identical to SEQ ID NO: 535276
  misc_feature: HIJSMM301BKSIH.16.6.A06.1.454.light.4.raw

SEQ ID NO: 577874 - DNA, 496 bp, Homo sapiens; identical to SEQ ID NO: 536802
  misc_feature: HIJSMM301EUFYO.5.24.C02.1.454.light.4.raw

SEQ ID NO: 577875 - DNA, 511 bp, Homo sapiens
  misc_feature: HIJSMM301BGMO6.40.73.G07.1.454.light.4.raw
tctagcgactcacgaccggtgctcgatttagctctacgctcagggcacgaccggtgctcgatttagtacacgtgattagggattggggaggaactgctcagttaggacccagagggaaccatggaagcccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcactgttttggcggttctccgactttcggcggagggaccgaaggtggaggtcgaaacgaacgt

SEQ ID NO: 577876 - DNA, 477 bp, Homo sapiens
  misc_feature: HIJSMM301AR2H3.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggaggccaaggtgcagatcaaacgaactgtgg

SEQ ID NO: 577877 - DNA, 484 bp, Homo sapiens; identical to SEQ ID NO: 536393
  misc_feature: HIJSMM301CHVE7.4.41.D08.1.454.light.4.raw

SEQ ID NO: 577878 - DNA, 475 bp, Homo sapiens; identical to SEQ ID NO: 556952
  misc_feature: HIJSMM301DOW5O.12.49.E05.1.454.light.4.raw

SEQ ID NO: 577879 - DNA, 383 bp, Homo sapiens
  misc_feature: HIJSMM301C70XR.41.35.D02.1.454.light.4.raw
tctatactatcacgaccggtgctcgatttagcacacgatagttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 577880 - DNA, 503 bp, Homo sapiens; identical to SEQ ID NO: 535140
  misc_feature: HIJSMM301EBPJS.18.37.D04.1.454.light.4.raw

SEQ ID NO: 577881 - DNA, 495 bp, Homo sapiens; identical to SEQ ID NO: 543631
  misc_feature: HIJSMM301A6REW.11.59.F04.1.454.light.4.raw

SEQ ID NO: 577882 - DNA, 515 bp, Homo sapiens
  misc_feature: HIJSMM301CNREQ.43.23.C01.1.454.light.4.raw
tgtgagtagtcacgaccggtgctcgatttagtacacgtgattagggattggcacgaccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctggtcacg

SEQ ID NO: 577883 - DNA, 511 bp, Homo sapiens
  misc_feature: HIJSMM301CB8W3.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcggagggaccaagctgaccgtcttaagtcagcccaaggctgccccctcggtcactctgttcccgcctcct

SEQ ID NO: 577884 - DNA, 494 bp, Homo sapiens; identical to SEQ ID NO: 534994
  misc_feature: HIJSMM301EWSR2.27.78.H01.1.454.light.4.raw

SEQ ID NO: 577885 - DNA, 494 bp, Homo sapiens; identical to SEQ ID NO: 534994
  misc_feature: HIJSMM301C2F0C.27.78.H01.1.454.light.4.raw

SEQ ID NO: 577886 - DNA, 496 bp, Homo sapiens; identical to SEQ ID NO: 535541
  misc_feature: HIJSMM301B9ENX.3.33.C11.1.454.light.4.raw

SEQ ID NO: 577887 - DNA, 493 bp, Homo sapiens
  misc_feature: HIJSMM301EBEVJ.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatccaccttcggccaagggacacgactggagaattaaacgaactgtggctgcaccatctgtcttcatt

SEQ ID NO: 577888 - DNA, 493 bp, Homo sapiens; identical to SEQ ID NO: 537422
  misc_feature: HIJSMM301ALNW7.9.34.D01.1.454.light.4.raw

SEQ ID NO: 577889 - DNA, 444 bp, Homo sapiens
  misc_feature: HIJSMM301CS1UU.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctaccccctcggtcactctgttcccaccctcctccgtgtctgat

SEQ ID NO: 577890 - DNA, 444 bp, Homo sapiens; identical to SEQ ID NO: 535192
  misc_feature: HIJSMM301EX3TA.5.9.A09.1.454.light.4.raw

SEQ ID NO: 577891 - DNA, 505 bp, Homo sapiens
  misc_feature: HIJSMM301A74S7.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaatgggaccaaggtcaccgtcctaggtcagcccaaggcccaacccccatgtca

SEQ ID NO: 577892 - DNA, 489 bp, Homo sapiens; identical to SEQ ID NO: 540247
  misc_feature: HIJSMM301CNDJ0.48.75.G09.1.454.light.4.raw

SEQ ID NO: 577893 - DNA, 496 bp, Homo sapiens; identical to SEQ ID NO: 535109
  misc_feature: HIJSMM301DBE37.16.78.H01.1.454.light.4.raw

SEQ ID NO: 577894 - DNA, 486 bp, Homo sapiens; identical to SEQ ID NO: 553923
  misc_feature: HIJSMM301BPG3H.49.81.H04.1.454.light.4.raw

SEQ ID NO: 577895 - DNA, 487 bp, Homo sapiens; identical to SEQ ID NO: 537573
  misc_feature: HIJSMM301AXM1F.3.10.A10.1.454.light.4.raw

SEQ ID NO: 577896 - DNA, 495 bp, Homo sapiens
  misc_feature: HIJSMM301DACPI.49.87.H10.1.454.light.4.raw
agtcgagagacacgaccggtgctcgatttagcagtactgcgttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagccctcccaggctcctcatctatgatacatccaacagggccactggcatcccagccaggttcagtggcaggtgggtctgggacagacttcactctcaccatcagcagcctagagcctgaagattttgcagtctattactgtcagcagcgttacaactggcctcccatgtactacttttggccaggggaccaagctggaaatcagacgaactgtggctgcaccat

SEQ ID NO: 577897 - DNA, 520 bp, Homo sapiens
  misc_feature: HIJSMM301C64IZ.43.81.H04.1.454.light.4.raw
tgtgagtagtcacgaccggtgctcgatttagtagtgtagattcgcggggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactagatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccgccctccctcactactca

SEQ ID NO: 577898 - DNA, 507 bp, Homo sapiens
  misc_feature: HIJSMM301CFDMR.10.71.G05.1.454.light.4.raw
catagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccaatttcggcggagggaccaaatagaggtcaaacgaactagtggctgcaccatctgtcttcatcttccccg

SEQ ID NO: 577899 - DNA, 490 bp, Homo sapiens
  misc_feature: HIJSMM301AOQOD.40.50.E06.1.454.light.4.raw
tctagcgactcacgaccggtgctcgatttagatctactgacaacacacaagggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggagacaccggtgatattgggacttataaccttgtctcttggtaccaacagcacccaggcaaagcccccaaacttatgatttatgagggcagccagcggccctcatggatttctagtcgcttctctgcctccaagtctggcaacacggcctccctgacaatctctggactccaggctgaggacgaggctgagtattactgctgcgcatttgcaggtagtagcgccccttatgtcttcgggactgggaccaggtcacagtcctaggtcag

SEQ ID NO: 577900 - DNA, 489 bp, Homo sapiens
  misc_feature: HIJSMM301EOF32.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtctaggtcacgcc

SEQ ID NO: 577901 - DNA, 494 bp, Homo sapiens; identical to SEQ ID NO: 534994
  misc_feature: HIJSMM301DXD75.27.78.H01.1.454.light.4.raw

SEQ ID NO: 577902 - DNA, 486 bp, Homo sapiens; identical to SEQ ID NO: 535054
  misc_feature: HIJSMM301AQ4HB.47.70.G04.1.454.light.4.raw

SEQ ID NO: 577903 - DNA, 447 bp, Homo sapiens; identical to SEQ ID NO: 535201
  misc_feature: HIJSMM301DJOZR.18.9.A09.1.454.light.4.raw

SEQ ID NO: 577904 - DNA, 501 bp, Homo sapiens; identical to SEQ ID NO: 535746
  misc_feature: HIJSMM301C1QI6.18.11.A11.1.454.light.4.raw

SEQ ID NO: 577905 - DNA, 511 bp, Homo sapiens
  misc_feature: HIJSMM301AGYN7.14.3.A03.1.454.light.4.raw
cgtctagtaccacgaccggtgctcgatttagagagcgtcacaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccgaaggtgaccgtcctaggtcgagcccaacggctgccccctccggtcactcttcg

SEQ ID NO: 577906 - DNA, 508 bp, Homo sapiens; identical to SEQ ID NO: 536388
  misc_feature: HIJSMM301C3T1K.11.57.F02.1.454.light.4.raw

SEQ ID NO: 577907 - DNA, 490 bp, Homo sapiens; identical to SEQ ID NO: 535234
  misc_feature: HIJSMM301CG0KI.17.21.B10.1.454.light.4.raw

SEQ ID NO: 577908 - DNA, 387 bp, Homo sapiens
  misc_feature: HIJSMM301CUPAG.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggccccaaatcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctgttcccaccctcctccgagcgacga

SEQ ID NO: 577909 - DNA, 475 bp, Homo sapiens
  misc_feature: HIJSMM301BLAJX.12.1.A01.1.454.light.4.raw
  modified_base (396)..(396): a, c, t, g, unknown or other
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagccctaaggtcctgatctatgctgcatccagtttgcaaagtggggtcccatcaaggttcagtggcagtgggtctgggacagatttcactctcaccatcagcagtctgcaacctgaagatctgcaacttntactgtcaacagagtaacagttaccctcccactttcggcggagggaccaaaggtggagatcaaacgaactgtggctgca

SEQ ID NO: 577910 - DNA, 503 bp, Homo sapiens
  misc_feature: HIJSMM301AKCEH.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaagtaggatatcaaacgaactagtggctgcaccatctgtcttcat

SEQ ID NO: 577911 - DNA, 483 bp, Homo sapiens
  misc_feature: HIJSMM301EPTRB.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgagattttgcaacttattactgccagcagtataatgattaccctatcaccttcggccgggggacacggctggaactaaacgaactgtggctgcacc

SEQ ID NO: 577912 - DNA, 505 bp, Homo sapiens; identical to SEQ ID NO: 565743
  misc_feature: HIJSMM301D9UZF.48.34.D01.1.454.light.4.raw

SEQ ID NO: 577913 - DNA, 514 bp, Homo sapiens
  misc_feature: HIJSMM301BSBX9.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcggggatcccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctgttccca

SEQ ID NO: 577914 - DNA, 494 bp, Homo sapiens
  misc_feature: HIJSMM301ES6R8.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacatcaagcgaactagtggctgcaccatctgtt

SEQ ID NO: 577915 - DNA, 486 bp, Homo sapiens; identical to SEQ ID NO: 535043
  misc_feature: HIJSMM301EFXZ1.46.35.D02.1.454.light.4.raw

SEQ ID NO: 577916 - DNA, 484 bp, Homo sapiens; identical to SEQ ID NO: 538157
  misc_feature: HIJSMM301DVXD4.26.70.G04.1.454.light.4.raw

SEQ ID NO: 577917 - DNA, 491 bp, Homo sapiens
  misc_feature: HIJSMM301CQZ1R.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaaacttactactgtcaacagagttacagtacccccctcaactttcggcggagggaccaaggcggagatcagacgaactgtggctgcaccatctgtctttca

SEQ ID NO: 577918 - DNA, 494 bp, Homo sapiens
  misc_feature: HIJSMM301CNUQ0.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgactgtgctgcaccatctgt

SEQ ID NO: 577919 - DNA, 506 bp, Homo sapiens
  misc_feature: HIJSMM301AX6LD.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgattaccatctcctgctctgggatcaacagcgaccttggtggttataactatgtgtcctggtaccaacaatatccaggcaaacccccaaagtcatcatttattgatgtcggtagtcggccctccgggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaacccactgtcactctcg

SEQ ID NO: 577920 - DNA, 494 bp, Homo sapiens; identical to SEQ ID NO: 534992
  misc_feature: HIJSMM301BOG5T.9.1.A01.1.454.light.4.raw

SEQ ID NO: 577921 - DNA, 497 bp, Homo sapiens
  misc_feature: HIJSMM301EQI4P.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccgagggaccgaacggtggaaagtacaaacgaacctagtggcgtgcgaccta

SEQ ID NO: 577922 - DNA, 500 bp, Homo sapiens
  misc_feature: HIJSMM301BG37K.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtcctaggtcagcccaaggccaaccc

SEQ ID NO: 577923 - DNA, 487 bp, Homo sapiens
  misc_feature: HIJSMM301E1N8U.3.10.A10.1.454.light.4.raw
  modified_base (438)..(438): a, c, t, g, unknown or other
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttaatctttatntcttcggatctgggaccagggtcaccgtcctaggtcagcccaaggccaa

SEQ ID NO: 577924 - DNA, 503 bp, Homo sapiens; identical to SEQ ID NO: 536579
  misc_feature: HIJSMM301D6NMV.27.78.H01.1.454.light.4.raw

SEQ ID NO: 577925 - DNA, 487 bp, Homo sapiens
  misc_feature: HIJSMM301EEQ70.13.15.B04.1.454.light.4.raw
  modified_base (396)..(396): a, c, t, g, unknown or other
tcacgtactacacgaccggtgctcgatttagacagtatatatccgcgggggtgcatgtcaggctgtgtccaccatggcctggactcctcttcttctcttgctcctctctcactgcacaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgnggatgaggctgactattactgtatgatttggccaagcaatgatgtggtattcggcggagggaccaagctgaccgtcctaggtcagaccccg

SEQ ID NO: 577926 - DNA, 509 bp, Homo sapiens; identical to SEQ ID NO: 537131
  misc_feature: HIJSMM301B3M4A.17.33.C11.1.454.light.4.raw

SEQ ID NO: 577927 - DNA, 489 bp, Homo sapiens; identical to SEQ ID NO: 535091
  misc_feature: HIJSMM301AJV6C.47.36.D03.1.454.light.4.raw

SEQ ID NO: 577928 - DNA, 520 bp, Homo sapiens; identical to SEQ ID NO: 535773
  misc_feature: HIJSMM301CA6XU.41.19.B08.1.454.light.4.raw

SEQ ID NO: 577929 - DNA, 500 bp, Homo sapiens
  misc_feature: HIJSMM301EHXVZ.13.73.G07.1.454.light.4.raw
tcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttatgtcttcgggactgtgaccaaggtcaccgtcctaggtcagcccaaggccaacccactgtcact

SEQ ID NO: 577930 - DNA, 444 bp, Homo sapiens; identical to SEQ ID NO: 535192
  misc_feature: HIJSMM301C01GQ.5.9.A09.1.454.light.4.raw

SEQ ID NO: 577931 - DNA, 500 bp, Homo sapiens
  misc_feature: HIJSMM301CIB3K.14.5.A05.1.454.light.4.raw
cgtctagtaccacgaccggtgctcgatttagatagatagacagggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccacgtggcatcccagccaggttcagtggcaggtgggtctgggacagacttcactctcaccatcagcagcctagagcctgaagtattttgctagtttattactgtcagcagcgtaccaactggcctcctgcgctctactttcggcggacgggaccaaggtggagatacaaacgaactgtggctgcaccatctgtccttcta

SEQ ID NO: 577932 - DNA, 492 bp, Homo sapiens
  misc_feature: HIJSMM301BHUQE.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccgaaggtggatctcaaaagaactgtggctgcaccta

SEQ ID NO: 577933 - DNA, 488 bp, Homo sapiens; identical to SEQ ID NO: 539884
  misc_feature: HIJSMM301A5KU1.7.85.H08.1.454.light.4.raw

SEQ ID NO: 577934 - DNA, 500 bp, Homo sapiens
  misc_feature: HIJSMM301D5QVJ.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccgaggggaaagagtcaccctctcatgcagggccagtgagattgttaccaccaacttagcctggtaccaacagaaacctggccagcctcccaggctcctcatttatggtgcatccacaagggccgctggtcgtcccagccaggttcagtggcagtggatctgcgacagagttcactctcaccgtcagcagcctgcagtctgaagtattttgctagtttattactgtcagcagtatgagaagtggttcaagactttcggcggagggaccgaaggtggagatacaaacgaactgtggctgcaccatctgtcttcatt

SEQ ID NO: 577935 - DNA, 516 bp, Homo sapiens
  misc_feature: HIJSMM301EJSJR.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttcccaccctcctcc

SEQ ID NO: 577936 - DNA, 495 bp, Homo sapiens
  misc_feature: HIJSMM301C347K.40.11.A11.1.454.light.4.raw
tctagcgactcacgaccggtgctcgatttagctacgactgcagggaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtcctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatcttcccgccat

SEQ ID NO: 577937 - DNA, 488 bp, Homo sapiens; identical to SEQ ID NO: 535990
  misc_feature: HIJSMM301EW9RO.11.28.C06.1.454.light.4.raw

SEQ ID NO: 577938 - DNA, 491 bp, Homo sapiens; identical to SEQ ID NO: 547784
  misc_feature: HIJSMM301ALPTM.8.53.E09.1.454.light.4.raw

SEQ ID NO: 577939 - DNA, 497 bp, Homo sapiens; identical to SEQ ID NO: 536371
  misc_feature: HIJSMM301CJTKB.16.78.H01.1.454.light.4.raw

SEQ ID NO: 577940 - DNA, 484 bp, Homo sapiens
  misc_feature: HIJSMM301C6WKL.52.5.A05.1.454.light.4.raw
cgcagtacgacacgaccggtgctcgatttagatagatagacaggggggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggtagggaccaagctgaccgtcctacgtcagccaaggctgccccctcggtcta

SEQ ID NO: 577941 - DNA, 484 bp, Homo sapiens
  misc_feature: HIJSMM301B2J0F.5.34.D01.1.454.light.4.raw
atcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaaggacacgactcggagattaaacgaactagtggctgcacca

SEQ ID NO: 577942 - DNA, 486 bp, Homo sapiens; identical to SEQ ID NO: 553608
  misc_feature: HIJSMM301BIWO7.11.12.B01.1.454.light.4.raw

SEQ ID NO: 577943 - DNA, 497 bp, Homo sapiens
  misc_feature: HIJSMM301BIY9J.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttcctaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 577944 - DNA, 486 bp, Homo sapiens; identical to SEQ ID NO: 535043
  misc_feature: HIJSMM301EQYOZ.46.35.D02.1.454.light.4.raw

SEQ ID NO: 577945 - DNA, 502 bp, Homo sapiens; identical to SEQ ID NO: 537363
  misc_feature: HIJSMM301BQWAA.18.23.C01.1.454.light.4.raw

SEQ ID NO: 577946 - DNA, 517 bp, Homo sapiens
  misc_feature: HIJSMM301EHRSU.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaaggattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgtcccgcctcctcacg

SEQ ID NO: 577947 - DNA, 485 bp, Homo sapiens; identical to SEQ ID NO: 535501
  misc_feature: HIJSMM301AET2W.3.10.A10.1.454.light.4.raw

SEQ ID NO: 577948 - DNA, 552 bp, Homo sapiens
  misc_feature: HIJSMM301CXWBO.17.25.C03.1.454.light.4.raw
  modified_base (505)..(505): a, c, t, g, unknown or other
cgtagactagcacgaccggtgctcgatttagtagtgtagatttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctaccaacaacgcataagcgtcgctgccgcaagcttcggngcatggtttagccccgtttcatcttcccgccatctgactagtctacg

SEQ ID NO: 577949 - DNA, 500 bp, Homo sapiens; identical to SEQ ID NO: 540484
  misc_feature: HIJSMM301ELK8F.48.73.G07.1.454.light.4.raw

SEQ ID NO: 577950 - DNA, 494 bp, Homo sapiens; identical to SEQ ID NO: 534992
  misc_feature: HIJSMM301EVSAW.9.1.A01.1.454.light.4.raw

SEQ ID NO: 577951 - DNA, 494 bp, Homo sapiens; identical to SEQ ID NO: 539784
  misc_feature: HIJSMM301DYD6S.22.57.F02.1.454.light.4.raw

SEQ ID NO: 577952 - DNA, 502 bp, Homo sapiens; identical to SEQ ID NO: 536253
  misc_feature: HIJSMM301AS8GY.21.22.B11.1.454.light.4.raw

SEQ ID NO: 577953 - DNA, 471 bp, Homo sapiens; identical to SEQ ID NO: 536321
  misc_feature: HIJSMM301A8RV9.15.8.A08.1.454.light.4.raw

SEQ ID NO: 577954 - DNA, 497 bp, Homo sapiens
  misc_feature: HIJSMM301CMLEA.52.36.D03.1.454.light.4.raw
cgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtcactc

SEQ ID NO: 577955 - DNA, 476 bp, Homo sapiens; identical to SEQ ID NO: 537812
  misc_feature: HIJSMM301CLCUY.3.82.H05.1.454.light.4.raw

SEQ ID NO: 577956 - DNA, 502 bp, Homo sapiens; identical to SEQ ID NO: 539314
  misc_feature: HIJSMM301AP6KD.21.81.H04.1.454.light.4.raw

SEQ ID NO: 577957 - DNA, 484 bp, Homo sapiens
  misc_feature: HIJSMM301BS994.49.57.F02.1.454.light.4.raw
agtcgagagacacgaccggtgctcgatttagctcgatatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacg

SEQ ID NO: 577958 - DNA, 508 bp, Homo sapiens
  misc_feature: HIJSMM301DGI3Q.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatggatgacagcctgaatggtccggtattcggcggagggaccaagctgaccgtcctcggtcagcccaaggctgccccccg

SEQ ID NO: 577959 - DNA, 486 bp, Homo sapiens; identical to SEQ ID NO: 535043
  misc_feature: HIJSMM301B7YIO.46.35.D02.1.454.light.4.raw

SEQ ID NO: 577960 - DNA, 508 bp, Homo sapiens
  misc_feature: HIJSMM301BSQT3.41.56.F01.1.454.light.4.raw
tctatactatcacgaccggtgctcgatttagcagacgtctgaacacacaaaggggggggtcacaagaggcagcgctctcgggacgtctccaccatggcctgggctctgctgctcctcactctcctcactcaggacacagggtcctgggcccagtctgccctgactcagcctgactccgtgtctgggtctcctggacagtcgatcaccatctcctgcactggaaccaacagtgatgttgggaattataaccttgtctcctggtaccaacaccacccaggcaaagcccccaaactcataatttatgagggcagtaagcggccctcaggggtttctaatcgcttctctggctccaagtctggcaacacggcctccctgacaatctctggactccaggctgaggacgaggctgattattactgctgctcatatgcaggtagtagggattgggtgttcggcggagggaccaagctgaccgtcctgggtcagcccaaggctgccccctcggtca

SEQ ID NO: 577961 - DNA, 488 bp, Homo sapiens
  misc_feature: HIJSMM301C0BJP.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtggaccaagctgaccgtctaggtcagccc

SEQ ID NO: 577962 - DNA, 485 bp, Homo sapiens; identical to SEQ ID NO: 535606
  misc_feature: HIJSMM301C12OA.47.46.E02.1.454.light.4.raw

SEQ ID NO: 577963 - DNA, 503 bp, Homo sapiens; identical to SEQ ID NO: 543363
  misc_feature: HIJSMM301BWVC7.19.78.H01.1.454.light.4.raw

SEQ ID NO: 577964 - DNA, 486 bp, Homo sapiens; identical to SEQ ID NO: 543576
  misc_feature: HIJSMM301BREXA.47.38.D05.1.454.light.4.raw

SEQ ID NO: 577965 - DNA, 494 bp, Homo sapiens
  misc_feature: HIJSMM301BY2RN.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgctcagcccaaggctgccccctcggtcactctgttcccg

SEQ ID NO: 577966 - DNA, 500 bp, Homo sapiens
  misc_feature: HIJSMM301BDS60.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatacaaacgaactgtggctgcaccatctgttcttcta

SEQ ID NO: 577967 - DNA, 493 bp, Homo sapiens; identical to SEQ ID NO: 546762
  misc_feature: HIJSMM301CKT45.26.12.B01.1.454.light.4.raw

SEQ ID NO: 577968 - DNA, 494 bp, Homo sapiens
  misc_feature: HIJSMM301EKZY8.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccagagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttccccg

SEQ ID NO: 577969 - DNA, 494 bp, Homo sapiens; identical to SEQ ID NO: 535276
  misc_feature: HIJSMM301AGHUE.16.6.A06.1.454.light.4.raw

SEQ ID NO: 577970 - DNA, 502 bp, Homo sapiens
  misc_feature: HIJSMM301D1OFL.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagatactactttacctcaagtgatcaccttcggccaagggacacgactggagattaaacg

SEQ ID NO: 577971 - DNA, 481 bp, Homo sapiens; identical to SEQ ID NO: 535993
  misc_feature: HIJSMM301A3WV8.21.25.C03.1.454.light.4.raw

SEQ ID NO: 577972 - DNA, 499 bp, Homo sapiens
  misc_feature: HIJSMM301DG94R.53.38.D05.1.454.light.4.raw
cgcgtatacacacgaccggtgctcgatttagtatctgatagttgggtttgggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctggtcact

SEQ ID NO: 577973 - DNA, 492 bp, Homo sapiens; identical to SEQ ID NO: 568489
  misc_feature: HIJSMM301AZ363.49.57.F02.1.454.light.4.raw

SEQ ID NO: 577974 - DNA, 503 bp, Homo sapiens; identical to SEQ ID NO: 536850
  misc_feature: HIJSMM301C3VDY.4.57.F02.1.454.light.4.raw

SEQ ID NO: 577975 - DNA, 496 bp, Homo sapiens; identical to SEQ ID NO: 536690
  misc_feature: HIJSMM301BNF2H.40.23.C01.1.454.light.4.raw

SEQ ID NO: 577976 - DNA, 369 bp, Homo sapiens
  misc_feature: HIJSMM301A9N7F.49.61.F06.1.454.light.4.raw
agtcgagagacacgaccggtgctcgatttagctacgctctaagggaaggggccaccctctcctgcagggccagtcagagcgttagcaacagttatgtagcctggtaccagcagaaacctggccagtctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggcttttttggccaggggaccaagctggagatcaagcgaactgtggctgcaccatctgtcttcatcttcccgccatctgatctctcgact

SEQ ID NO: 577977 - DNA, 498 bp, Homo sapiens
  misc_feature: HIJSMM301EMGXI.52.68.G02.1.454.light.4.raw
cgcagtacgacacgaccggtgctcgatttagtcgatagtgaagggaaagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttttgatgtacactggtaccagcagcttccgggaacagcccccaaactcctcatctttggtaacagcaatcggccctccggggtccctgaccgattctctggctccaagtctggcacctcagcctccctggccatcactgggctccaggctgaggatgaggctgattattactgccagtcctatgacagcagcctgagtgtcttttgggtcttcggaactgggaccaaggtcaccgtcctaggtcacg

SEQ ID NO: 577978 - DNA, 508 bp, Homo sapiens
  misc_feature: HIJSMM301ALXSA.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctcg

SEQ ID NO: 577979 - DNA, 486 bp, Homo sapiens; identical to SEQ ID NO: 535043
  misc_feature: HIJSMM301BVEA7.46.35.D02.1.454.light.4.raw

SEQ ID NO: 577980 - DNA, 486 bp, Homo sapiens
  misc_feature: HIJSMM301A0U4Q.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccgaagctgaccgtcctgcgtcagcccaaggctgccccctcggtcactctgttcccgccctcctcgctacgtaga

SEQ ID NO: 577981 - DNA, 480 bp, Homo sapiens; identical to SEQ ID NO: 535291
  misc_feature: HIJSMM301ANRSF.22.59.F04.1.454.light.4.raw

SEQ ID NO: 577982 - DNA, 498 bp, Homo sapiens; identical to SEQ ID NO: 535469
  misc_feature: HIJSMM301AGZXG.12.18.B07.1.454.light.4.raw

SEQ ID NO: 577983 - DNA, 485 bp, Homo sapiens
  misc_feature: HIJSMM301C8HUN.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcgcgagggacaaggcgagatcagacgaactgtggctgcaccatctgtcttcta

SEQ ID NO: 577984 - DNA, 502 bp, Homo sapiens; identical to SEQ ID NO: 543913
  misc_feature: HIJSMM301EP9O5.18.26.C04.1.454.light.4.raw

SEQ ID NO: 577985 - DNA, 505 bp, Homo sapiens; identical to SEQ ID NO: 538312
  misc_feature: HIJSMM301AESH8.48.26.C04.1.454.light.4.raw

SEQ ID NO: 577986 - DNA, 507 bp, Homo sapiens; identical to SEQ ID NO: 535641
  misc_feature: HIJSMM301BYVVI.10.88.H11.1.454.light.4.raw

SEQ ID NO: 577987 - DNA, 483 bp, Homo sapiens
  misc_feature: HIJSMM301DFUU8.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcgagggaccaaggtggagagtcaaagaa

SEQ ID NO: 577988 - DNA, 511 bp, Homo sapiens
  misc_feature: HIJSMM301BYMKY.19.59.F04.1.454.light.4.raw
  modified_base (234)..(234): a, c, t, g, unknown or other
  modified_base (243)..(243): a, c, t, g, unknown or other
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaanaatttttgngtcctggtaccagcagctcccaggaacagcccccaaactcctcatttttgacaataataagcgaccctcagggattcctgaccgattctctggctccaagtctggcacgtcagccaccctgggcatcaccggactccagactgggacgaggccgattattactgcggaacatgggatagcagcctgagtactgtgataatcggcggagggaccaagctgaccgtcctaagtcagcccaaggctgccccctcggtcactctcgttccca

SEQ ID NO: 577989 - DNA, 496 bp, Homo sapiens
  misc_feature: HIJSMM301CHRW6.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaacggccaacccccactgtcta

SEQ ID NO: 577990 - DNA, 455 bp, Homo sapiens
  misc_feature: HIJSMM301CXOON.15.11.A11.1.454.light.4.raw
tctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaagggccctcgctacttgatgaagcttaacactgatggcagccacagtaagggggacgggatccctgatcgcttctcaggctccagctctggggctgagcgctacctcaccatctccagcctccagtctgaggatgaggctgactattactgtcagacctggggcactggc

SEQ ID NO: 577991 - DNA, 508 bp, Homo sapiens
  misc_feature: HIJSMM301C7VJR.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggcggagggccaagctgaccgtcctaagtcagcccaagctgccccctggtcactctcg

SEQ ID NO: 577992 - DNA, 512 bp, Homo sapiens
  misc_feature: HIJSMM301CZR1V.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcagggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggcctgccccctcggtccactctgttcccaccctccc

SEQ ID NO: 577993 - DNA, 471 bp, Homo sapiens; identical to SEQ ID NO: 537461
  misc_feature: HIJSMM301DQOYA.7.81.H04.1.454.light.4.raw

SEQ ID NO: 577994 - DNA, 489 bp, Homo sapiens
  misc_feature: HIJSMM301CE880.19.57.F02.1.454.light.4.raw
tactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttcctcctcactttcggcggagggaccaaggtggagatcaagcgaactgtggctgcaccatctgt

SEQ ID NO: 577995 - DNA, 472 bp, Homo sapiens
  misc_feature: HIJSMM301CN3VV.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggctgggacagcagcactgcccgctatgtcttcggaactggaccaaggtcaccgtcctaagtcacg

SEQ ID NO: 577996 - DNA, 473 bp, Homo sapiens
  misc_feature: HIJSMM301BADK7.53.83.H06.1.454.light.4.raw
cgcgtatacacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcgaccatcacctgttctggagacaaattgactgataaatatgctggctggtatcggcagaagccaggccagtcgcctgtgttggtcatctatcaggatagcaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagaccccg

SEQ ID NO: 577997 - DNA, 499 bp, Homo sapiens
  misc_feature: HIJSMM301B357O.18.11.A11.1.454.light.4.raw
  modified_base (469)..(469): a, c, t, g, unknown or other
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttattactgtcagcaatactatagtcctcctctcacgttcggcggaggaccaaggtgganatcaaacgactgtggctgcacatctgtctt

SEQ ID NO: 577998 - DNA, 493 bp, Homo sapiens; identical to SEQ ID NO: 535770
  misc_feature: HIJSMM301A6B64.51.71.G05.1.454.light.4.raw

SEQ ID NO: 577999 - DNA, 490 bp, Homo sapiens
  misc_feature: HIJSMM301AZ0S9.12.67.G01.1.454.light.4.raw
atacgacgtacacgaccggtgctcgatttagagtatacatattgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtggaccaaggtcaccgtcctacgtcagcccaaggccaaccccactgtcactctgttcccaccctcctctacgtcgtat

SEQ ID NO: 578000 - DNA, 488 bp, Homo sapiens; identical to SEQ ID NO: 539884
  misc_feature: HIJSMM301EP1VO.7.85.H08.1.454.light.4.raw

SEQ ID NO: 578001 - DNA, 522 bp, Homo sapiens
  misc_feature: HIJSMM301BHOZE.41.19.B08.1.454.light.4.raw
tctatactatcacgaccggtgctcgatttagtgagtcagtaagggggggtcgtcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggcccaaccccactgtcactctgttccccaccctcctcat

SEQ ID NO: 578002 - DNA, 508 bp, Homo sapiens
  misc_feature: HIJSMM301CJ53Y.21.22.B11.1.454.light.4.raw
  modified_base (430)..(430): a, c, t, g, unknown or other
  modified_base (464)..(464): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacncaacatggggatgacaatctggagcggtttgggngttcggcggagggacccaaatggaccgtcctaggtcagccccaa

SEQ ID NO: 578003 - DNA, 492 bp, Homo sapiens
  misc_feature: HIJSMM301A3HRA.9.86.H09.1.454.light.4.raw
tgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccacctcctcagacgtatca

SEQ ID NO: 578004 - DNA, 503 bp, Homo sapiens
  misc_feature: HIJSMM301A7V5R.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgacccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctg

SEQ ID NO: 578005 - DNA, 482 bp, Homo sapiens; identical to SEQ ID NO: 535216
  misc_feature: HIJSMM301EFNT1.17.26.C04.1.454.light.4.raw

SEQ ID NO: 578006 - DNA, 515 bp, Homo sapiens
  misc_feature: HIJSMM301D2EG2.51.43.D10.1.454.light.4.raw
cgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaaggccaaccccactgtcactctgttcccgccctcctctcgt

SEQ ID NO: 578007 - DNA, 487 bp, Homo sapiens
  misc_feature: HIJSMM301DODY2.40.85.H08.1.454.light.4.raw
tctagcgactcacgaccggtgctcgatttagtatcactcagtcgcggggcaaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagccccg

SEQ ID NO: 578008 - DNA, 382 bp, Homo sapiens
  misc_feature: HIJSMM301CCXCD.41.28.C06.1.454.light.4.raw
tctatactatcacgaccggtgctcgatttagagctcacgtattgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcacatctgtcttcatcttcccgccatctgaatagtataga

SEQ ID NO: 578009 - DNA, 483 bp, Homo sapiens; identical to SEQ ID NO: 542200
  misc_feature: HIJSMM301EGYLC.7.75.G09.1.454.light.4.raw

SEQ ID NO: 578010 - DNA, 440 bp, Homo sapiens; identical to SEQ ID NO: 535667
  misc_feature: HIJSMM301B84QU.41.9.A09.1.454.light.4.raw

SEQ ID NO: 578011 - DNA, 488 bp, Homo sapiens; identical to SEQ ID NO: 538612
  misc_feature: HIJSMM301A07E2.4.59.F04.1.454.light.4.raw

SEQ ID NO: 578012 - DNA, 463 bp, Homo sapiens; identical to SEQ ID NO: 535008
  misc_feature: HIJSMM301A0KNT.10.9.A09.1.454.light.4.raw

SEQ ID NO: 578013 - DNA, 511 bp, Homo sapiens; identical to SEQ ID NO: 539247
  misc_feature: HIJSMM301EFSM3.15.34.D01.1.454.light.4.raw

SEQ ID NO: 578014 - DNA, 495 bp, Homo sapiens; identical to SEQ ID NO: 538269
  misc_feature: HIJSMM301DODUG.9.1.A01.1.454.light.4.raw

SEQ ID NO: 578015 - DNA, 485 bp, Homo sapiens
  misc_feature: HIJSMM301BBJVR.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagatgaccgtcctaggtcagaccccg

SEQ ID NO: 578016 - DNA, 490 bp, Homo sapiens; identical to SEQ ID NO: 542534
  misc_feature: HIJSMM301ALD1K.16.68.G02.1.454.light.4.raw

SEQ ID NO: 578017 - DNA, 503 bp, Homo sapiens; identical to SEQ ID NO: 536834
  misc_feature: HIJSMM301CG24H.2.35.D02.1.454.light.4.raw

SEQ ID NO: 578018 - DNA, 503 bp, Homo sapiens; identical to SEQ ID NO: 538884
  misc_feature: HIJSMM301C5RZ6.27.78.H01.1.454.light.4.raw

SEQ ID NO: 578019 - DNA, 444 bp, Homo sapiens; identical to SEQ ID NO: 535192
  misc_feature: HIJSMM301DBD74.5.9.A09.1.454.light.4.raw

SEQ ID NO: 578020 - DNA, 507 bp, Homo sapiens
  misc_feature: HIJSMM301C1527.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccgaaggtggagatcaaacgaactgtggctgcaccatctgtcttcta

SEQ ID NO: 578021 - DNA, 494 bp, Homo sapiens; identical to SEQ ID NO: 534992
  misc_feature: HIJSMM301CJ5YR.9.1.A01.1.454.light.4.raw

SEQ ID NO: 578022 - DNA, 500 bp, Homo sapiens
  misc_feature: HIJSMM301BZQ73.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggcccatcgagattccgcgtcagtggatctgggacagatttcactctcaccatcagcagcctgcagcctgaagattttgcaacttactattgtcagcagcgcacaatttcccgctcactttcggcggagggaccaaggtggagatcaaacgaactgtggctgcaccatctgtcttcatcttccccg

SEQ ID NO: 578023 - DNA, 493 bp, Homo sapiens
  misc_feature: HIJSMM301AP9M7.12.57.F02.1.454.light.4.raw
atacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcagtgggcacactaccttcgccatcgcctggcatcaacaacagccagagaggggccctcgatacttgatgattgttaacagtgatggcagccacaacaagggggacgggatccctgatcgcttctcaggctccagttctggggctgagcgctacctcaccatctccagccctccagtctgaggatgaggctgactattactgtcagacctggggcactggcattgtggtattcggcggagggacgaagctgaccgtcctgggtcagcccaaggctcgccccctc

SEQ ID NO: 578024 - DNA, 507 bp, Homo sapiens; identical to SEQ ID NO: 538063
  misc_feature: HIJSMM301DQBFC.47.85.H08.1.454.light.4.raw

SEQ ID NO: 578025 - DNA, 444 bp, Homo sapiens; identical to SEQ ID NO: 535192
  misc_feature: HIJSMM301BVZ80.5.9.A09.1.454.light.4.raw

SEQ ID NO: 578026 - DNA, 462 bp, Homo sapiens; identical to SEQ ID NO: 550306
  misc_feature: HIJSMM301CRYKI.49.9.A09.1.454.light.4.raw

SEQ ID NO: 578027 - DNA, 462 bp, Homo sapiens; identical to SEQ ID NO: 550306
  misc_feature: HIJSMM301EP3DS.49.9.A09.1.454.light.4.raw

SEQ ID NO: 578028 - DNA, 482 bp, Homo sapiens
  misc_feature: HIJSMM301EX8O8.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggacccagggctggagatcagacgaa

SEQ ID NO: 578029 - DNA, 498 bp, Homo sapiens
  misc_feature: HIJSMM301C8I9D.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttacttcggcggaggaccgaaggtggagatcaaacgaactgtggctgcaccatctgtcttcatcttccccg

SEQ ID NO: 578030 - DNA, 504 bp, Homo sapiens
  misc_feature: HIJSMM301BNZTH.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccaggctgaccgtcctgagtcagcccaaggctgccccccg

SEQ ID NO: 578031 - DNA, 497 bp, Homo sapiens
  misc_feature: HIJSMM301B9PZR.43.37.D04.1.454.light.4.raw
tgtgagtagtcacgaccggtgctcgatttagtagcatactgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgacgttggttattataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattattgcagttcatatacaagcagcaccactattatgtcttcggagctgggaccaaggtcaccgtcctaggtcagcccaaggccaa

SEQ ID NO: 578032 - DNA, 508 bp, Homo sapiens
  misc_feature: HIJSMM301A1NY1.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattatactgtgcaccgtgggatgacatcctgaatggtccggtgttcggcggagggccaggctgaccgtcctaagtcagcccaaggctgcccccc

SEQ ID NO: 578033 - DNA, 508 bp, Homo sapiens; identical to SEQ ID NO: 555268
  misc_feature: HIJSMM301C7RK5.40.12.B01.1.454.light.4.raw

SEQ ID NO: 578034 - DNA, 501 bp, Homo sapiens
  misc_feature: HIJSMM301BMNL8.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtccaagggaccgacgggtggaaagtacaaacgaaactagtggctgcaccatctgtcttcat

SEQ ID NO: 578035 - DNA, 491 bp, Homo sapiens
  misc_feature: HIJSMM301C23FU.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctcatcttcccgccat

SEQ ID NO: 578036 - DNA, 503 bp, Homo sapiens
  misc_feature: HIJSMM301DCGDR.3.71.G05.1.454.light.4.raw
agacgcactccacgaccggtgctcgatttagtgtcgtcgcaagagagagggggcagaagcagagttctggggtgtctccaccatggcctcggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctataggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccgaagctcgccccctcggtccactcttccg

SEQ ID NO: 578037 - DNA, 508 bp, Homo sapiens
  misc_feature: HIJSMM301AZB97.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaacggtggagatcaaacgaactcgtggctgcaccatctgtcttcta

SEQ ID NO: 578038 - DNA, 517 bp, Homo sapiens
  misc_feature: HIJSMM301B97RL.10.38.D05.1.454.light.4.raw
catagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccct

SEQ ID NO: 578039 - DNA, 495 bp, Homo sapiens; identical to SEQ ID NO: 535596
  misc_feature: HIJSMM301AJY3I.10.79.H02.1.454.light.4.raw

SEQ ID NO: 578040 - DNA, 508 bp, Homo sapiens
  misc_feature: HIJSMM301DMUDD.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtctac

SEQ ID NO: 578041 - DNA, 508 bp, Homo sapiens
  misc_feature: HIJSMM301ARDFA.48.80.H03.1.454.light.4.raw
agtatacatacacgaccggtgctcgatttagctgtgcgtcgaagggaaagggggaggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgctattttattactgtcagcactataataactggccacgtggacgttcggccgaagggaccgaaggtaggaaatacaaacgaactgtggctgca

SEQ ID NO: 578042 - DNA, 506 bp, Homo sapiens
  misc_feature: HIJSMM301CJ2IZ.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgcctccttggccatcactgggctcgaggctgacgatgaggctgattactactgtctgtcctatgacgacgacctacagactccggtttcggcggagggactaagctgaccgtcctaagtcagcccaaggctcgccccctcggtcactctcgttcccg

SEQ ID NO: 578043 - DNA, 486 bp, Homo sapiens; identical to SEQ ID NO: 535043
  misc_feature: HIJSMM301CQNOP.46.35.D02.1.454.light.4.raw

SEQ ID NO: 578044 - DNA, 486 bp, Homo sapiens; identical to SEQ ID NO: 535043
  misc_feature: HIJSMM301AWSU7.46.35.D02.1.454.light.4.raw

SEQ ID NO: 578045 - DNA, 476 bp, Homo sapiens; identical to SEQ ID NO: 538026
  misc_feature: HIJSMM301BC4QG.13.76.G10.1.454.light.4.raw

SEQ ID NO: 578046 - DNA, 483 bp, Homo sapiens
  misc_feature: HIJSMM301CJZNJ.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccaagggaccgaaggtggaaatcaaacgaactagtggctgcacca

SEQ ID NO: 578047 - DNA, 486 bp, Homo sapiens; identical to SEQ ID NO: 542305
  misc_feature: HIJSMM301BHJKC.40.83.H06.1.454.light.4.raw

SEQ ID NO: 578048 - DNA, 505 bp, Homo sapiens; identical to SEQ ID NO: 535503
  misc_feature: HIJSMM301DBF8A.8.28.C06.1.454.light.4.raw

SEQ ID NO: 578049 - DNA, 489 bp, Homo sapiens; identical to SEQ ID NO: 535620
  misc_feature: HIJSMM301C7F9I.47.38.D05.1.454.light.4.raw

SEQ ID NO: 578050 - DNA, 471 bp, Homo sapiens; identical to SEQ ID NO: 537461
  misc_feature: HIJSMM301CY3MQ.7.81.H04.1.454.light.4.raw

SEQ ID NO: 578051 - DNA, 489 bp, Homo sapiens; identical to SEQ ID NO: 546040
  misc_feature: HIJSMM301BP1XI.11.12.B01.1.454.light.4.raw

SEQ ID NO: 578052 - DNA, 489 bp, Homo sapiens; identical to SEQ ID NO: 553074
  misc_feature: HIJSMM301EOS5U.14.33.C11.1.454.light.4.raw

SEQ ID NO: 578053 - DNA, 499 bp, Homo sapiens; identical to SEQ ID NO: 535899
  misc_feature: HIJSMM301CAZH9.19.78.H01.1.454.light.4.raw

SEQ ID NO: 578054 - DNA, 508 bp, Homo sapiens; identical to SEQ ID NO: 541396
  misc_feature: HIJSMM301AI9PW.17.33.C11.1.454.light.4.raw

SEQ ID NO: 578055 - DNA, 482 bp, Homo sapiens
  misc_feature: HIJSMM301DQIF6.40.81.H04.1.454.light.4.raw
tctagcgactcacgaccggtgctcgatttagtagtgtagattcgcggggactgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagccagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaa

SEQ ID NO: 578056 - DNA, 520 bp, Homo sapiens
  misc_feature: HIJSMM301A8Q66.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccgaacggaccgaacggtacggaagtacgaagacgaaccgtagtggcgtcgcgaccaactctcgtcttctactcttcccgt

SEQ ID NO: 578057 - DNA, 479 bp, Homo sapiens; identical to SEQ ID NO: 538734
  misc_feature: HIJSMM301A1S6Y.8.53.E09.1.454.light.4.raw

SEQ ID NO: 578058 - DNA, 491 bp, Homo sapiens; identical to SEQ ID NO: 542796
  misc_feature: HIJSMM301BOL7U.19.57.F02.1.454.light.4.raw

SEQ ID NO: 578059 - DNA, 495 bp, Homo sapiens; identical to SEQ ID NO: 535007
  misc_feature: HIJSMM301C7QUH.22.5.A05.1.454.light.4.raw

SEQ ID NO: 578060 - DNA, 490 bp, Homo sapiens; identical to SEQ ID NO: 536481
  misc_feature: HIJSMM301D9574.13.46.E02.1.454.light.4.raw

SEQ ID NO: 578061 - DNA, 447 bp, Homo sapiens; identical to SEQ ID NO: 535020
  misc_feature: HIJSMM301ELB3L.18.9.A09.1.454.light.4.raw

SEQ ID NO: 578062 - DNA, 463 bp, Homo sapiens; identical to SEQ ID NO: 535062
  misc_feature: HIJSMM301DJBKA.11.73.G07.1.454.light.4.raw

SEQ ID NO: 578063 - DNA, 511 bp, Homo sapiens
  misc_feature: HIJSMM301EPM0L.9.20.B09.1.454.light.4.raw
tgatacgtctcacgaccggtgctcgatttagtgtagtgtgaagggggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacactgccaccctgaccatcagcagggccgaagccggggatgaggccgactattactgccaggtgtggcatattatcacccccgtgttcggcgggggaccgaagctgaccgtcctaggtcagcccaaggctgccccctcggtcactctgttcccaccctcctcagacgtatca

SEQ ID NO: 578064 - DNA, 464 bp, Homo sapiens
  misc_feature: HIJSMM301AOP2T.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagata

SEQ ID NO: 578065 - DNA, 485 bp, Homo sapiens
  misc_feature: HIJSMM301DSHOK.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaagaactgtggctgcaccatctgtcttcatt

SEQ ID NO: 578066 - DNA, 488 bp, Homo sapiens; identical to SEQ ID NO: 542699
  misc_feature: HIJSMM301BMQS1.12.51.E07.1.454.light.4.raw

SEQ ID NO: 578067 - DNA, 448 bp, Homo sapiens; identical to SEQ ID NO: 538166
  misc_feature: HIJSMM301DCC2I.18.9.A09.1.454.light.4.raw

SEQ ID NO: 578068 - DNA, 485 bp, Homo sapiens; identical to SEQ ID NO: 535501
  misc_feature: HIJSMM301BO6GF.3.10.A10.1.454.light.4.raw

SEQ ID NO: 578069 - DNA, 489 bp, Homo sapiens
  misc_feature: HIJSMM301AJEK6.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactctacttcggtcggagggaccaaggtcgagagtcaaacgaactgtggctgcaccatctgtctt

SEQ ID NO: 578070 - DNA, 505 bp, Homo sapiens
  misc_feature: HIJSMM301CLQ9C.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgcccccaaactcatcatttatgatgccactaagcggccctcaggggtttctaatcgcttctctggctccaagtctggcaacacggcctccctgacaatctctgggctccaggctggaggacgaggctgattactactgctgctcatatgcaggtcgtatctcttatgtcttcggaactgggaccaaggtccaccgtcctaggtcagcccaaggcccaaccccactg

SEQ ID NO: 578071 - DNA, 488 bp, Homo sapiens
  misc_feature: HIJSMM301C8VB7.4.9.A09.1.454.light.4.raw
agcactgtagcacgaccggtgctcgatttagcgagacgcgcagggggaactgctcagttaggacccagacggaaccatggaagccccagcgcagcttcttttcctcctgctactctggctcccagataccactggagaaatagtgatgacgcagtctccagccaccctgtctgtgtctccaggggcaagggccaccctctcctgcagggccagtcagagtgtcagcaacaacttagcctggtaccagcagaaacctggccagcctcccaggctcctcatctatggtacatccaccagggccactggtattccagtcaggtttagtggcagcgggtctgggacagaattcactctcaccatcagcagcctgcagtctgaagattttgcagtttattactgtcagcagtataataattggcctccttcactttcgcctgggaccaaagtggatatcaaacgaaactgtggctgcaccatctgtcttcatt

SEQ ID NO: 578072 - DNA, 488 bp, Homo sapiens; identical to SEQ ID NO: 543022
  misc_feature: HIJSMM301EPTM3.9.59.F04.1.454.light.4.raw

SEQ ID NO: 578073 - DNA, 521 bp, Homo sapiens; identical to SEQ ID NO: 538715
  misc_feature: HIJSMM301E2DC7.27.23.C01.1.454.light.4.raw

SEQ ID NO: 578074 - DNA, 475 bp, Homo sapiens
  misc_feature: HIJSMM301BJLPY.7.81.H04.1.454.light.4.raw
cgtgtctctacacgaccggtgctcgatttagtagtgtagattcgcgggggagtcagtctcagtcaggacacagcatggacatgagggtccccgctcagtctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgatttgcaacttactactgtcaacagagttccactaccccaatcactttcggcctgggactgaagtgcatatgaagagaactgtggctgca

SEQ ID NO: 578075 - DNA, 465 bp, Homo sapiens
  misc_feature: HIJSMM301C4XVY.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccactactcgta

SEQ ID NO: 578076 - DNA, 491 bp, Homo sapiens
  misc_feature: HIJSMM301EY0ZK.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccggccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccatctgtt

SEQ ID NO: 578077 - DNA, 503 bp, Homo sapiens; identical to SEQ ID NO: 538973
  misc_feature: HIJSMM301D8SMH.5.86.H09.1.454.light.4.raw

SEQ ID NO: 578078 - DNA, 507 bp, Homo sapiens
  misc_feature: HIJSMM301CBJXJ.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcacttttcggcggagggaccaaggtggagatcaaacgaactgtggctgcaccatctgtt

SEQ ID NO: 578079 - DNA, 502 bp, Homo sapiens
  misc_feature: HIJSMM301B44ZM.48.27.C05.1.454.light.4.raw
agtatacatacacgaccggtgctcgatttagacgcgatcgaagggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctggt

SEQ ID NO: 578080 - DNA, 508 bp, Homo sapiens
  misc_feature: HIJSMM301CI2VN.13.36.D03.1.454.light.4.raw
  modified_base (446)..(446): a, c, t, g, unknown or other
tcacgtactacacgaccggtgctcgatttagctgcgtcacgatctctcttggggggggtcacaagaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttangtcttcgggactgtgaccaaggtcaccgtcctaggtcagcccaaggcccaaccccactgtca

SEQ ID NO: 578081 - DNA, 505 bp, Homo sapiens
  misc_feature: HIJSMM301DDMHY.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctggagcccgaagattttgcggtttattactgtcagcagcgtgccgactcggcccctcacggttcggcggagggaccaaggtggacatcaaacgactgtggctgcaccatctgtcttcatccttcccg

SEQ ID NO: 578082 - DNA, 490 bp, Homo sapiens
  misc_feature: HIJSMM301C4LN3.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagttattccttttacttcggccctggaccaaagtggatatcaaacgaactgtggctgcaccat

SEQ ID NO: 578083 - DNA, 503 bp, Homo sapiens
  misc_feature: HIJSMM301DL6OJ.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtccagcccaaggctgccccctc

SEQ ID NO: 578084 - DNA, 486 bp, Homo sapiens; identical to SEQ ID NO: 539294
  misc_feature: HIJSMM301DL638.12.33.C11.1.454.light.4.raw

SEQ ID NO: 578085 - DNA, 505 bp, Homo sapiens
  misc_feature: HIJSMM301A4HJ6.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacaaagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcact

SEQ ID NO: 578086 - DNA, 515 bp, Homo sapiens
  misc_feature: HIJSMM301DYJRD.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattattgtgcagcatgggatgacagcctgagtggtccttgggtgttcggcggagggaccaagctgaccgtcctaagtcagcccaaggctgccccctcggtcactctgttcccaccctcctcg

SEQ ID NO: 578087 - DNA, 516 bp, Homo sapiens
  misc_feature: HIJSMM301BX3XU.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccatgttgcaccgcaaagcgggacccagaccctggagcctcagttggaagcagccgatccagcctgcggagcctgtggggcaggtcagcccaaggcctgccccctcggtccactctgttcccaccctcctccacg

SEQ ID NO: 578088 - DNA, 460 bp, Homo sapiens; identical to SEQ ID NO: 539553
  misc_feature: HIJSMM301AZAAH.11.86.H09.1.454.light.4.raw

SEQ ID NO: 578089 - DNA, 497 bp, Homo sapiens
  misc_feature: HIJSMM301A92Q7.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagttcgctctcgaagtgttcggcggagggaccgagctgaccgtcctacgtcagcccaaggctccg

SEQ ID NO: 578090 - DNA, 503 bp, Homo sapiens
  misc_feature: HIJSMM301B73YN.48.25.C03.1.454.light.4.raw
  modified_base (240)..(240): a, c, t, g, unknown or other
agtatacatacacgaccggtgctcgatttagtagtgtagatttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggcccctgtgctggtcatctttgaggacaacaaacgaccctccgggatccctgagagattctctggctccagctcagggacaatggccaccttgactatcaatgggcccaggtggacgatgaggctgactactactgttcctcaacagacagtagtggtgatcgagggctggttcggcggagggaccaagctgaccgtcctaagtcagcccaaggctgccccctcggtcactc

SEQ ID NO: 578091 - DNA, 476 bp, Homo sapiens; identical to SEQ ID NO: 537368
  misc_feature: HIJSMM301B7RJ9.7.83.H06.1.454.light.4.raw

SEQ ID NO: 578092 - DNA, 509 bp, Homo sapiens
  misc_feature: HIJSMM301E1E4C.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagccccaaactttggttatcagggcaataagcggcctcagggtttctaatcgcttctctggctccaagtctggcaacacggccgccctgacaatctctgggctccaggctgacgacgaggctgatttttactgctgctcatatgtcaggtgatcacacttttatgttcgggactgggaccaaggtcaccgtcctaggtcagcccaaggccaaccccactgtcactcttcg

SEQ ID NO: 578093 - DNA, 489 bp, Homo sapiens; identical to SEQ ID NO: 535139
  misc_feature: HIJSMM301CAKO4.14.55.E11.1.454.light.4.raw

SEQ ID NO: 578094 - DNA, 502 bp, Homo sapiens; identical to SEQ ID NO: 538663
  misc_feature: HIJSMM301DRA4V.48.36.D03.1.454.light.4.raw

SEQ ID NO: 578095 - DNA, 501 bp, Homo sapiens
  misc_feature: HIJSMM301B67IM.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggcctgccccctcggtcactctgttcccacctcctcgctacgtaga

SEQ ID NO: 578096 - DNA, 444 bp, Homo sapiens; identical to SEQ ID NO: 535192
  misc_feature: HIJSMM301AO3AJ.5.9.A09.1.454.light.4.raw

SEQ ID NO: 578097 - DNA, 495 bp, Homo sapiens; identical to SEQ ID NO: 536931
  misc_feature: HIJSMM301EV6JG.10.33.C11.1.454.light.4.raw

SEQ ID NO: 578098 - DNA, 513 bp, Homo sapiens
  misc_feature: HIJSMM301BNC8R.16.1.A01.1.454.light.4.raw
tgtactactccacgaccggtgctcgatttagacgtctcatcaggggggggtctcgaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttaggtgattataactttgtctcctggtaccaacaacacccaggcaaagcccccaaactcatcatttatgaagtctctaagcggccctcaggggtatctaatcgcttctctggctccaagtctgggcaacacggcctccctgaccgtctctggcctccagactgaggacgaggctgattattactgccactcatatagaagtagtactactcctgtggttttcggcggagggaccaagctgaccgtcctaggtcagcccaaggctgccccctccggtcactctgtt

SEQ ID NO: 578099 - DNA, 486 bp, Homo sapiens
  misc_feature: HIJSMM301B941T.4.33.C11.1.454.light.4.raw
agcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccaaaggtggagatcaaacgaa

SEQ ID NO: 578100 - DNA, 447 bp, Homo sapiens; identical to SEQ ID NO: 535201
  misc_feature: HIJSMM301DX62U.18.9.A09.1.454.light.4.raw

SEQ ID NO: 578101 - DNA, 495 bp, Homo sapiens; identical to SEQ ID NO: 543631
  misc_feature: HIJSMM301BH8AI.11.59.F04.1.454.light.4.raw

SEQ ID NO: 578102 - DNA, 484 bp, Homo sapiens; identical to SEQ ID NO: 535297
  misc_feature: HIJSMM301BJG9H.10.35.D02.1.454.light.4.raw

SEQ ID NO: 578103 - DNA, 516 bp, Homo sapiens; identical to SEQ ID NO: 535549
  misc_feature: HIJSMM301C6NHF.14.70.G04.1.454.light.4.raw

SEQ ID NO: 578104 - DNA, 454 bp, Homo sapiens; identical to SEQ ID NO: 534964
  misc_feature: HIJSMM301C3DDL.19.86.H09.1.454.light.4.raw

SEQ ID NO: 578105 - DNA, 510 bp, Homo sapiens
  misc_feature: HIJSMM301BTTHR.51.86.H09.1.454.light.4.raw
cgatcgtatacacgaccggtgctcgatttagtgctatagacttgggtttgggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccgaaggtggaaatcaaacgaactgtggctgcaccatctgtctt

SEQ ID NO: 578106 - DNA, 483 bp, Homo sapiens; identical to SEQ ID NO: 575196
  misc_feature: HIJSMM301AO0O6.41.34.D01.1.454.light.4.raw

SEQ ID NO: 578107 - DNA, 509 bp, Homo sapiens; identical to SEQ ID NO: 539359
  misc_feature: HIJSMM301EWPQ3.47.85.H08.1.454.light.4.raw

SEQ ID NO: 578108 - DNA, 447 bp, Homo sapiens; identical to SEQ ID NO: 535020
  misc_feature: HIJSMM301D8B2Z.18.9.A09.1.454.light.4.raw

SEQ ID NO: 578109 - DNA, 509 bp, Homo sapiens; identical to SEQ ID NO: 541829
  misc_feature: HIJSMM301EG7EZ.17.28.C06.1.454.light.4.raw

SEQ ID NO: 578110 - DNA, 468 bp, Homo sapiens; identical to SEQ ID NO: 540909
  misc_feature: HIJSMM301B6DNU.3.82.H05.1.454.light.4.raw

SEQ ID NO: 578111 - DNA, 444 bp, Homo sapiens; identical to SEQ ID NO: 535594
  misc_feature: HIJSMM301AN1KD.9.9.A09.1.454.light.4.raw

SEQ ID NO: 578112 - DNA, 484 bp, Homo sapiens; identical to SEQ ID NO: 541039
  misc_feature: HIJSMM301C4IU3.46.35.D02.1.454.light.4.raw

SEQ ID NO: 578113 - DNA, 517 bp, Homo sapiens
  misc_feature: HIJSMM301ANBTB.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccagactcccaggcccctcatctatggtgcatccaacagggccactggcatcccagccaggttcagtagcagtgggtatgggacagacttcactctcaccatcatcagcctggagcctgaagatgttgcagtttattactgtcaacatcgtaccgagtcggccgtccggggcctacgtttccggcccgtcgggaccgaaggtggaggatacaaacgaactgtggctgcaccactctgtcttcta

SEQ ID NO: 578114 - DNA, 484 bp, Homo sapiens; identical to SEQ ID NO: 541039
  misc_feature: HIJSMM301DYL3E.46.35.D02.1.454.light.4.raw

SEQ ID NO: 578115 - DNA, 494 bp, Homo sapiens; identical to SEQ ID NO: 543247
  misc_feature: HIJSMM301AGY8U.22.57.F02.1.454.light.4.raw

SEQ ID NO: 578116 - DNA, 483 bp, Homo sapiens; identical to SEQ ID NO: 535413
  misc_feature: HIJSMM301A0ZAV.26.78.H01.1.454.light.4.raw

SEQ ID NO: 578117 - DNA, 490 bp, Homo sapiens; identical to SEQ ID NO: 547085
  misc_feature: HIJSMM301CQKF3.12.51.E07.1.454.light.4.raw

SEQ ID NO: 578118 - DNA, 480 bp, Homo sapiens
  misc_feature: HIJSMM301BL6JE.40.23.C01.1.454.light.4.raw
tctagcgactcacgaccggtgctcgatttagtacacgtgattagggattggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggcc

SEQ ID NO: 578119 - DNA, 505 bp, Homo sapiens
  misc_feature: HIJSMM301CZ7QM.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagatttgcagtttattactgtcagcagcgtagcaactggcctcggttcacttttggccaggggaccaagctggagatcaaacgaactgtggctgcaccatctgtctttatcttccccg

SEQ ID NO: 578120 - DNA, 506 bp, Homo sapiens
  misc_feature: HIJSMM301EHZ5C.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaacccccactgtcactctgttcccaccctt

SEQ ID NO: 578121 - DNA, 447 bp, Homo sapiens
  misc_feature: HIJSMM301DR0BF.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcgaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctcgccccctcggtcactctgttccccaccctcctcgtactagacg

SEQ ID NO: 578122 - DNA, 522 bp, Homo sapiens
  misc_feature: HIJSMM301AF5PB.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaacggctgccccctcggtcactctgttcccaccct

SEQ ID NO: 578123 - DNA, 523 bp, Homo sapiens
  misc_feature: HIJSMM301DML9L.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagtttcatatacaaccagtgacacttgggtgttcggcggagggaccaggctgaccgtcctaggtcagcccaaggctcgccccctcggtcactctgttcccaccct

SEQ ID NO: 578124 - DNA, 480 bp, Homo sapiens; identical to SEQ ID NO: 535291
  misc_feature: HIJSMM301C5O07.22.59.F04.1.454.light.4.raw

SEQ ID NO: 578125 - DNA, 496 bp, Homo sapiens; identical to SEQ ID NO: 536690
  misc_feature: HIJSMM301DIXCZ.40.23.C01.1.454.light.4.raw

SEQ ID NO: 578126 - DNA, 503 bp, Homo sapiens; identical to SEQ ID NO: 536834
  misc_feature: HIJSMM301AN4TR.2.35.D02.1.454.light.4.raw

SEQ ID NO: 578127 - DNA, 497 bp, Homo sapiens
  misc_feature: HIJSMM301EAAS5.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcgccaaggaccaaggtggaaatcaaacgaactgtggctgcaccatctgtcttcta

SEQ ID NO: 578128 - DNA, 497 bp, Homo sapiens; identical to SEQ ID NO: 535286
  misc_feature: HIJSMM301E05VF.18.59.F04.1.454.light.4.raw

SEQ ID NO: 578129 - DNA, 484 bp, Homo sapiens
  misc_feature: HIJSMM301CXX8S.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaacggtggaaatacaaacgaactagtggctgcaccta

SEQ ID NO: 578130 - DNA, 515 bp, Homo sapiens
  misc_feature: HIJSMM301CH4GM.49.38.D05.1.454.light.4.raw
agtcgagagacacgaccggtgctcgatttagtatctgatagttgggtttgggggggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctcgccccctcggtccactctgttcccaccctcct

SEQ ID NO: 578131 - DNA, 503 bp, Homo sapiens
  misc_feature: HIJSMM301A3I4S.21.22.B11.1.454.light.4.raw
tcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggt

SEQ ID NO: 578132 - DNA, 503 bp, Homo sapiens; identical to SEQ ID NO: 536834
  misc_feature: HIJSMM301B4N4B.2.35.D02.1.454.light.4.raw

SEQ ID NO: 578133 - DNA, 486 bp, Homo sapiens
  misc_feature: HIJSMM301ADWAN.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttatactgtcagcagtataatgactggcctccgacgttcggccaagggaccaaggtggaatcaaacgaactgtggctgcaccat

SEQ ID NO: 578134 - DNA, 480 bp, Homo sapiens
  misc_feature: HIJSMM301CQTCM.40.8.A08.1.454.light.4.raw
tctagcgactcacgaccggtgctcgatttagcatactctacagggggagctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaccagcctgcaggctgaagatgtggcggtttattactgtcaacaatattctggtcaatctcattctttcggcggtagggaccaaggtggagatcagacgaa

SEQ ID NO: 578135 - DNA, 521 bp, Homo sapiens
  misc_feature: HIJSMM301DSUCS.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccaccctcctc

SEQ ID NO: 578136 - DNA, 519 bp, Homo sapiens; identical to SEQ ID NO: 551966
  misc_feature: HIJSMM301CQ3ZN.43.59.F04.1.454.light.4.raw

SEQ ID NO: 578137 - DNA, 484 bp, Homo sapiens
  misc_feature: HIJSMM301AN9HI.49.83.H06.1.454.light.4.raw
agtcgagagacacgaccggtgctcgatttagatcacgtgcgtcgcggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgtcaacactataatcattattctccggccactttcggccctgggaccaggctagatatcggacgaactgttgctgcacc

SEQ ID NO: 578138 - DNA, 499 bp, Homo sapiens; identical to SEQ ID NO: 536578
  misc_feature: HIJSMM301AQWVD.22.27.C05.1.454.light.4.raw

SEQ ID NO: 578139 - DNA, 500 bp, Homo sapiens
  misc_feature: HIJSMM301COG18.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtcctt

SEQ ID NO: 578140 - DNA, 505 bp, Homo sapiens; identical to SEQ ID NO: 535503
  misc_feature: HIJSMM301ETCQ3.8.28.C06.1.454.light.4.raw

SEQ ID NO: 578141 - DNA, 491 bp, Homo sapiens
  misc_feature: HIJSMM301CMS3C.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctccatctatgatgcgtccacccagggccgacctggtttccctacgccaggttcagtggcagtgcgtctgggacgagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 578142 - DNA, 487 bp, Homo sapiens; identical to SEQ ID NO: 537220
  misc_feature: HIJSMM301EOOS5.16.53.E09.1.454.light.4.raw

SEQ ID NO: 578143 - DNA, 501 bp, Homo sapiens; identical to SEQ ID NO: 535509
  misc_feature: HIJSMM301EPQ0J.15.56.F01.1.454.light.4.raw

SEQ ID NO: 578144 - DNA, 522 bp, Homo sapiens; identical to SEQ ID NO: 568215
  misc_feature: HIJSMM301BICKE.27.23.C01.1.454.light.4.raw

SEQ ID NO: 578145 - DNA, 490 bp, Homo sapiens
  misc_feature: HIJSMM301CTRU1.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtcttcactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgca

SEQ ID NO: 578146 - DNA, 489 bp, Homo sapiens
  misc_feature: HIJSMM301EI5SM.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccaggggccactggtttcccacgccaggttcagtggcagtgcgtctgggacagagttcactctcaccatcaacagcctgcagtctgaagattttgtcagtttattactgtcagcagtatcataactggccgctcaccttcggccaagggacacgactggagattaaacgaactagtggctgcaccat

SEQ ID NO: 578147 - DNA, 511 bp, Homo sapiens
  misc_feature: HIJSMM301AVS5Y.40.11.A11.1.454.light.4.raw
tctagcgactcacgaccggtgctcgatttagctacgactgcaggggcgagcaagatggtgttgcagacccaggtcttcatttttcttgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggtccgaagggaccgaaggtcggaaagtcaaacggaactgtggctagcaccatctgtcttcatcttcccgtccatctcgtaacg

SEQ ID NO: 578148 - DNA, 485 bp, Homo sapiens
  misc_feature: HIJSMM301CK7KO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcacat

SEQ ID NO: 578149 - DNA, 515 bp, Homo sapiens
  misc_feature: HIJSMM301EXIJ8.16.66.F11.1.454.light.4.raw
  modified_base (496)..(496): a, c, t, g, unknown or other
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtccactctgttcccnccctccctcgagtagtaca

SEQ ID NO: 578150 - DNA, 519 bp, Homo sapiens
  misc_feature: HIJSMM301ARP0K.7.86.H09.1.454.light.4.raw
  modified_base (210)..(210): a, c, t, g, unknown or other
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaacctttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 578151 - DNA, 469 bp, Homo sapiens
  misc_feature: HIJSMM301B7PVS.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagccctaagctcctgatctacgatgcatccaatttggaaacaggggtcccatcaaggttcagtggaagtggatctgggacagtattttactttcaccatcagcagcctgcacgcctgaagatattgcaacatattactgtcagcagtatgataatctcccgatcaccttcggccaagggacacgacgtggagaattaaacgaa

SEQ ID NO: 578152 - DNA, 489 bp, Homo sapiens
  misc_feature: HIJSMM301AOJRZ.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggtcggtttattattgtcaacaattattttagtgctccgtacacttttggccaggggaccaagttggagatcaaacgaa

SEQ ID NO: 578153 - DNA, 444 bp, Homo sapiens; identical to SEQ ID NO: 535192
  misc_feature: HIJSMM301AT3V5.5.9.A09.1.454.light.4.raw

SEQ ID NO: 578154 - DNA, 494 bp, Homo sapiens
  misc_feature: HIJSMM301CZAVX.5.20.B09.1.454.light.4.raw
atcagacacgcacgaccggtgctcgatttagtgtagtgtgaagggggagctacaacaggcaggcaggggcagcaagatggtgttgcagacccaggtcttcatttctctgttgctctggatctctggtgcctgcggggcatcgtgatgacccagtctccagactccctggctgtgtctctgggcgagagggccgccatcaactgcaagtccagccagaatattttatacagttccaataataagaactacttagcttggtaccaacagaaaccaggacagcctcctaagctgctcatttcctgggcgtctacccgggaatccggggtcctgaccgattcactggcagcgggtctgggacagatttcactctcaccatcgacagcctgcaggctgaggatgtggcagtttatactgtcagcaacattatagttcgtggacgttggccaggggaccaaggtggaaatcaaacgaactgtggctgcaccatctgtctt

SEQ ID NO: 578155 - DNA, 509 bp, Homo sapiens
  misc_feature: HIJSMM301C17BJ.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggaccaaagtggaaatcaaacgaactgtggctgcaccatctgtcttcatcttcccgccatt

SEQ ID NO: 578156 - DNA, 486 bp, Homo sapiens
  misc_feature: HIJSMM301B4U7S.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctactttattactgtcagcagcgtagcaactggcctctcactttcggcggagggaccaggggtggagatcagacgaa

SEQ ID NO: 578157 - DNA, 480 bp, Homo sapiens
  misc_feature: HIJSMM301EAOL1.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagagaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattatattgccagtcctatgacaacaccctgcgtggttttggctgttcggcggcgggacc

SEQ ID NO: 578158 - DNA, 489 bp, Homo sapiens
  misc_feature: HIJSMM301BBR4O.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgctagtttattactgtcagcagtataatagctggcccgcgacgttcggccgaagggaccgaggtggaattacaaacgaactgtggctgcaccatctgtctt

SEQ ID NO: 578159 - DNA, 445 bp, Homo sapiens; identical to SEQ ID NO: 544276
  misc_feature: HIJSMM301C7N2M.5.9.A09.1.454.light.4.raw

SEQ ID NO: 578160 - DNA, 505 bp, Homo sapiens
  misc_feature: HIJSMM301AYGUA.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggtcaagacggttgggtgttcggcggagggaccaagctgaccgtcctaggtcagcccaaggctgccccctcggtcactctgttcccgccctcctcg

SEQ ID NO: 578161 - DNA, 458 bp, Homo sapiens
  misc_feature: HIJSMM301BTGPU.49.8.A08.1.454.light.4.raw
agtcgagagacacgaccggtgctcgatttagcatactctacaggggagtcagtcctaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacagggtcccatcaaggttcagtggaagtggctctgggacagattttactttcaccatcagcagactgcagcctgaagatattgcaacatattactgtcaacagtatgatagtctcccgctcactttcggcggaggaccaaggtgagatcaaacgaa

SEQ ID NO: 578162 - DNA, 490 bp, Homo sapiens; identical to SEQ ID NO: 572896
  misc_feature: HIJSMM301EXBBQ.14.55.E11.1.454.light.4.raw

SEQ ID NO: 578163 - DNA, 479 bp, Homo sapiens
  misc_feature: HIJSMM301ENF9L.48.37.D04.1.454.light.4.raw
agtatacatacacgaccggtgctcgatttagtagcatactgttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccccg

SEQ ID NO: 578164 - DNA, 492 bp, Homo sapiens; identical to SEQ ID NO: 534967
  misc_feature: HIJSMM301EPYCF.47.64.F09.1.454.light.4.raw

SEQ ID NO: 578165 - DNA, 490 bp, Homo sapiens; identical to SEQ ID NO: 535234
  misc_feature: HIJSMM301EQ3MI.17.21.B10.1.454.light.4.raw

SEQ ID NO: 578166 - DNA, 489 bp, Homo sapiens; identical to SEQ ID NO: 535139
  misc_feature: HIJSMM301BV7V6.14.55.E11.1.454.light.4.raw

SEQ ID NO: 578167 - DNA, 489 bp, Homo sapiens; identical to SEQ ID NO: 548452
  misc_feature: HIJSMM301BCBZZ.26.37.D04.1.454.light.4.raw

SEQ ID NO: 578168 - DNA, 485 bp, Homo sapiens; identical to SEQ ID NO: 535880
  misc_feature: HIJSMM301D53P3.7.75.G09.1.454.light.4.raw

SEQ ID NO: 578169 - DNA, 497 bp, Homo sapiens; identical to SEQ ID NO: 535286
  misc_feature: HIJSMM301CFV1A.18.59.F04.1.454.light.4.raw

SEQ ID NO: 578170 - DNA, 495 bp, Homo sapiens; identical to SEQ ID NO: 554722
  misc_feature: HIJSMM301CPKVN.27.78.H01.1.454.light.4.raw

SEQ ID NO: 578171 - DNA, 516 bp, Homo sapiens
  misc_feature: HIJSMM301A2YM4.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcgggcggagggaccaagctggccgtcctaggtcagcccaaggctgccccctcggtcactctgttccccaccctcctcgagtagtaca

SEQ ID NO: 578172 - DNA, 506 bp, Homo sapiens; identical to SEQ ID NO: 536355
  misc_feature: HIJSMM301B30Z7.47.85.H08.1.454.light.4.raw

SEQ ID NO: 578173 - DNA, 447 bp, Homo sapiens; identical to SEQ ID NO: 535020
  misc_feature: HIJSMM301ATHNQ.18.9.A09.1.454.light.4.raw

SEQ ID NO: 578174 - DNA, 514 bp, Homo sapiens
  misc_feature: HIJSMM301AU6NF.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctcgccccctcggtccactctcgttcccg

SEQ ID NO: 578175 - DNA, 491 bp, Homo sapiens
  misc_feature: HIJSMM301C9K6R.51.28.C06.1.454.light.4.raw
cgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcggacgcaggctgtggatgaggctgacttttactgtcaggcgtgggacagcgacactgccgtgttcggcgggggaccaagctgaccgtcctcggtcagcccaaggctgccccctcggtcta

SEQ ID NO: 578176 - DNA, 475 bp, Homo sapiens
  misc_feature: HIJSMM301DKN6W.41.8.A08.1.454.light.4.raw
tctatactatcacgaccggtgctcgatttagcatactctacagggggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgaactgtggctgcacc

SEQ ID NO: 578177 - DNA, 514 bp, Homo sapiens; identical to SEQ ID NO: 540552
  misc_feature: HIJSMM301CA5PI.16.66.F11.1.454.light.4.raw

SEQ ID NO: 578178 - DNA, 498 bp, Homo sapiens; identical to SEQ ID NO: 553247
  misc_feature: HIJSMM301EF2SX.40.57.F02.1.454.light.4.raw

SEQ ID NO: 578179 - DNA, 490 bp, Homo sapiens; identical to SEQ ID NO: 535420
  misc_feature: HIJSMM301D2GZ0.3.72.G06.1.454.light.4.raw

SEQ ID NO: 578180 - DNA, 487 bp, Homo sapiens
  misc_feature: HIJSMM301B9FTJ.43.36.D03.1.454.light.4.raw
  modified_base (441)..(441): a, c, t, g, unknown or other
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccaccatcagcacgccttagcctggtaccagcacaagtcagggcagcctcctaagttgcttcttttactggacttcgatccgcgcatctggggtccctgaccgattcatgggcagcggctctgggacagacttcgctctcaccatcaacagcctccaggctgaggatgcggcggtttatattgtcaacaatattttagngctccgtacacttttggccaggggaccaagttggagatcaaacgaa

SEQ ID NO: 578181 - DNA, 447 bp, Homo sapiens; identical to SEQ ID NO: 535201
  misc_feature: HIJSMM301DFZWN.18.9.A09.1.454.light.4.raw

SEQ ID NO: 578182 - DNA, 482 bp, Homo sapiens; identical to SEQ ID NO: 536622
  misc_feature: HIJSMM301BBB5V.7.85.H08.1.454.light.4.raw

SEQ ID NO: 578183 - DNA, 499 bp, Homo sapiens; identical to SEQ ID NO: 537739
  misc_feature: HIJSMM301DK5SJ.12.86.H09.1.454.light.4.raw

SEQ ID NO: 578184 - DNA, 482 bp, Homo sapiens
  misc_feature: HIJSMM301BDF6L.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcatcaatatggtgaccggcccacgttcggccaagggaccaaggtggaaatcaaacga

SEQ ID NO: 578185 - DNA, 487 bp, Homo sapiens
  misc_feature: HIJSMM301DCKQO.19.21.B10.1.454.light.4.raw
tactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 578186 - DNA, 454 bp, Homo sapiens; identical to SEQ ID NO: 536347
  misc_feature: HIJSMM301EED3T.19.86.H09.1.454.light.4.raw

SEQ ID NO: 578187 - DNA, 482 bp, Homo sapiens
  misc_feature: HIJSMM301D1PE5.48.19.B08.1.454.light.4.raw
agtatacatacacgaccggtgctcgatttagtgagtcagtaaggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggcctcaggggtccctgatcgcttctctggctccaagtctggcaacacggcctccctgaccatctctgggctccaggctgaggatgaggctgattatactgctgctcatatgcaggcaggctacacttgggtgttcggcggagggaccaagctgaccgtctaggtcagaccccg

SEQ ID NO: 578188 - DNA, 497 bp, Homo sapiens; identical to SEQ ID NO: 535286
  misc_feature: HIJSMM301D1FK6.18.59.F04.1.454.light.4.raw

SEQ ID NO: 578189 - DNA, 485 bp, Homo sapiens; identical to SEQ ID NO: 536630
  misc_feature: HIJSMM301ETGSR.13.56.F01.1.454.light.4.raw

SEQ ID NO: 578190 - DNA, 520 bp, Homo sapiens
  misc_feature: HIJSMM301CAY8H.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggcattgatgaggctgtctacttctgtcaggcgtggacgaacagcgtggtggttcggcgggagggaccgaacgtcttgaccggttaccttaggttacaggcccaaacgggaccgtgcccccccgtccggttccgaacccttcc

SEQ ID NO: 578191 - DNA, 498 bp, Homo sapiens
  misc_feature: HIJSMM301CQ7HK.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgttcagcagcgtaccaagtggcctccgacttttggccagggggccaagctggagatcagacgaactgtggctgcaccatctgtcttcatcttccccg

SEQ ID NO: 578192 - DNA, 512 bp, Homo sapiens
  misc_feature: HIJSMM301ER9OM.7.34.D01.1.454.light.4.raw
cgtgtctctacacgaccggtgctcgatttagatcgtctgtgttgggtttggggggggtctcaggaggcagcactctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgtttcggcggagggaccaagctgaccgtcctgcgtcagcccaaggctgccccctcggtcact

SEQ ID NO: 578193 - DNA, 520 bp, Homo sapiens
  misc_feature: HIJSMM301C8L6O.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgaccctcctccgtgt

SEQ ID NO: 578194 - DNA, 486 bp, Homo sapiens; identical to SEQ ID NO: 535043
  misc_feature: HIJSMM301DR2WJ.46.35.D02.1.454.light.4.raw

SEQ ID NO: 578195 - DNA, 495 bp, Homo sapiens
  misc_feature: HIJSMM301AZFYC.43.61.F06.1.454.light.4.raw
tgtgagtagtcacgaccggtgctcgatttagctacgctctaaggaaagggggaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtacgggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaactgtggctgcaccatctgtctt

SEQ ID NO: 578196 - DNA, 504 bp, Homo sapiens; identical to SEQ ID NO: 557936
  misc_feature: HIJSMM301BFOI2.19.78.H01.1.454.light.4.raw

SEQ ID NO: 578197 - DNA, 484 bp, Homo sapiens; identical to SEQ ID NO: 567361
  misc_feature: HIJSMM301EO1OV.8.49.E05.1.454.light.4.raw

SEQ ID NO: 578198 - DNA, 509 bp, Homo sapiens; identical to SEQ ID NO: 544573
  misc_feature: HIJSMM301BBK80.10.88.H11.1.454.light.4.raw

SEQ ID NO: 578199 - DNA, 492 bp, Homo sapiens
  misc_feature: HIJSMM301EO1SR.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggatttattactgcatgcaagctctacaactccttactacttttggccaggggaccaagctggagatacaaacgaactgt

SEQ ID NO: 578200 - DNA, 454 bp, Homo sapiens; identical to SEQ ID NO: 534964
  misc_feature: HIJSMM301DSE0N.19.86.H09.1.454.light.4.raw

SEQ ID NO: 578201 - DNA, 496 bp, Homo sapiens
  misc_feature: HIJSMM301CWNLY.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaggtggagatcaaaacgaact

SEQ ID NO: 578202 - DNA, 491 bp, Homo sapiens; identical to SEQ ID NO: 535176
  misc_feature: HIJSMM301EB6DK.13.39.D06.1.454.light.4.raw

SEQ ID NO: 578203 - DNA, 487 bp, Homo sapiens
  misc_feature: HIJSMM301AIB0E.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgctaacttattattgtcaacaaagttatgagacccctgccactttcggccctggaccatagtggatatagaaacgaactgtggctgcacc

SEQ ID NO: 578204 - DNA, 509 bp, Homo sapiens; identical to SEQ ID NO: 535670
  misc_feature: HIJSMM301DZUTY.47.23.C01.1.454.light.4.raw

SEQ ID NO: 578205 - DNA, 492 bp, Homo sapiens
  misc_feature: HIJSMM301DE9E3.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcagtttttactgtcagcagtatagtaactggcctccgtacacttttggccaggggaccaagctagaaatcaaacgaactgtggctgcaccatctgtcttcta

SEQ ID NO: 578206 - DNA, 484 bp, Homo sapiens; identical to SEQ ID NO: 535400
  misc_feature: HIJSMM301ES6Y9.46.26.C04.1.454.light.4.raw

SEQ ID NO: 578207 - DNA, 520 bp, Homo sapiens; identical to SEQ ID NO: 537173
  misc_feature: HIJSMM301DX861.27.23.C01.1.454.light.4.raw

SEQ ID NO: 578208 - DNA, 467 bp, Homo sapiens
  misc_feature: HIJSMM301APYBA.40.68.G02.1.454.light.4.raw
tctagcgactcacgaccggtgctcgatttagtcgatagtgaagggaaagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatccttcccgccatctgaagtcgctaga

SEQ ID NO: 578209 - DNA, 498 bp, Homo sapiens
  misc_feature: HIJSMM301AVVJP.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgatttattactgtgttggatgggacagcagcctgagtgcttatgtcttcggaactgggaccacggtcaccgtcct

SEQ ID NO: 578210 - DNA, 500 bp, Homo sapiens; identical to SEQ ID NO: 535310
  misc_feature: HIJSMM301A11AG.47.66.F11.1.454.light.4.raw

SEQ ID NO: 578211 - DNA, 484 bp, Homo sapiens
  misc_feature: HIJSMM301BIDVZ.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaactgaccgtcctaggtcagcccaaggctgccccctcggtcactctgttcccgccctcctctacgtgagct

SEQ ID NO: 578212 - DNA, 507 bp, Homo sapiens
  misc_feature: HIJSMM301AHEVH.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 578213 - DNA, 487 bp, Homo sapiens
  misc_feature: HIJSMM301CJIFG.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggttattactgcatgcagggtacagtgtggccttcgctcgcattcggcggagggaccaaggtggagatcaaacgaa

SEQ ID NO: 578214 - DNA, 492 bp, Homo sapiens
  misc_feature: HIJSMM301D8V6O.49.58.F03.1.454.light.4.raw
agtcgagagacacgaccggtgctcgatttagtctgatcgagaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtagcaactggcctctcactttcgggcggacgggaccaaggtggagatcaaacgaactgtggctgcacatctgt

SEQ ID NO: 578215 - DNA, 499 bp, Homo sapiens; identical to SEQ ID NO: 562346
  misc_feature: HIJSMM301DOARL.40.81.H04.1.454.light.4.raw

SEQ ID NO: 578216 - DNA, 505 bp, Homo sapiens
  misc_feature: HIJSMM301CX701.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtggaaagtcaaacgaactagtggctgcaccatctgtcttcatcttccccg

SEQ ID NO: 578217 - DNA, 485 bp, Homo sapiens; identical to SEQ ID NO: 544818
  misc_feature: HIJSMM301CTTD4.13.36.D03.1.454.light.4.raw

SEQ ID NO: 578218 - DNA, 485 bp, Homo sapiens; identical to SEQ ID NO: 544818
  misc_feature: HIJSMM301BEDE1.13.36.D03.1.454.light.4.raw

SEQ ID NO: 578219 - DNA, 509 bp, Homo sapiens
  misc_feature: HIJSMM301CC6CY.48.30.C08.1.454.light.4.raw
agtatacatacacgaccggtgctcgatttagtctgacgtcaaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggacctcggtccaaggacgacgactggagattaaacgtaactagtggcgtgcaccactctgtcttctactcttcccgtccca

SEQ ID NO: 578220 - DNA, 483 bp, Homo sapiens
  misc_feature: HIJSMM301CQ3HL.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtggatatcagacgaa

SEQ ID NO: 578221 - DNA, 505 bp, Homo sapiens
  misc_feature: HIJSMM301ELMQ3.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 578222 - DNA, 495 bp, Homo sapiens; identical to SEQ ID NO: 566148
  misc_feature: HIJSMM301CD233.51.38.D05.1.454.light.4.raw

SEQ ID NO: 578223 - DNA, 502 bp, Homo sapiens; identical to SEQ ID NO: 564875
  misc_feature: HIJSMM301DKSCM.48.36.D03.1.454.light.4.raw

SEQ ID NO: 578224 - DNA, 509 bp, Homo sapiens
  misc_feature: HIJSMM301D1JJB.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattacttgcagctcatatgcaggcagcagcagtccccatgtgatcttcggcggggggaccaaggctgaccgtcctaggtcagcccaaggctgccccccg

SEQ ID NO: 578225 - DNA, 504 bp, Homo sapiens
  misc_feature: HIJSMM301D460Q.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtc

SEQ ID NO: 578226 - DNA, 446 bp, Homo sapiens
  misc_feature: HIJSMM301EK0MD.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggccaaggtcaccgtcctaagtcagcccaaggccaacccctctgtcactctgttcccgccctcctccatactcgta

SEQ ID NO: 578227 - DNA, 466 bp, Homo sapiens; identical to SEQ ID NO: 535366
  misc_feature: HIJSMM301AP51E.13.4.A04.1.454.light.4.raw

SEQ ID NO: 578228 - DNA, 504 bp, Homo sapiens; identical to SEQ ID NO: 539091
  misc_feature: HIJSMM301CD3ZS.8.28.C06.1.454.light.4.raw

SEQ ID NO: 578229 - DNA, 466 bp, Homo sapiens
  misc_feature: HIJSMM301A64CO.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggaggaccaaggtggagatacg

SEQ ID NO: 578230 - DNA, 476 bp, Homo sapiens; identical to SEQ ID NO: 538026
  misc_feature: HIJSMM301AZBLO.13.76.G10.1.454.light.4.raw

SEQ ID NO: 578231 - DNA, 487 bp, Homo sapiens; identical to SEQ ID NO: 536536
  misc_feature: HIJSMM301DS42P.26.45.E01.1.454.light.4.raw

SEQ ID NO: 578232 - DNA, 493 bp, Homo sapiens; identical to SEQ ID NO: 535770
  misc_feature: HIJSMM301AH84H.51.71.G05.1.454.light.4.raw

SEQ ID NO: 578233 - DNA, 507 bp, Homo sapiens
  misc_feature: HIJSMM301DNLRP.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatagtcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtccagcccaaggctgccccctcggtcactctgtcccc

SEQ ID NO: 578234 - DNA, 495 bp, Homo sapiens
  misc_feature: HIJSMM301CSKDI.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctggggacagagttcactctcaccatcagcagcctgcaggctgaagatgtggcagtttattactgtcagcaatatttcgtgctccgtacacttttggccaggggacccaggtggaggatcagacgaactgtggctgcaccatctgtcttcatcttccg

SEQ ID NO: 578235 - DNA, 491 bp, Homo sapiens
  misc_feature: HIJSMM301C2EPT.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctctcatcaagtatgcttccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactggagattaaacgaactgtggctgcaccatctgtctt

SEQ ID NO: 578236 - DNA, 473 bp, Homo sapiens
  misc_feature: HIJSMM301DXJOH.12.49.E05.1.454.light.4.raw
  modified_base (437)..(437): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttatactgtcaaaagtataacagtgcccccttnaccttcggccaagggacacgactggagattagaacg

SEQ ID NO: 578237 - DNA, 463 bp, Homo sapiens
  misc_feature: HIJSMM301AZ5X9.49.75.G09.1.454.light.4.raw
agtcgagagacacgaccggtgctcgatttagtatagacatcagggggagtcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcacgtttcggcgggggaccgaaggtggagatccagcgaa

SEQ ID NO: 578238 - DNA, 485 bp, Homo sapiens
  misc_feature: HIJSMM301B9AA4.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccgaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 578239 - DNA, 506 bp, Homo sapiens; identical to SEQ ID NO: 549591
  misc_feature: HIJSMM301CTGOS.17.87.H10.1.454.light.4.raw

SEQ ID NO: 578240 - DNA, 493 bp, Homo sapiens
  misc_feature: HIJSMM301CBZ7O.11.71.G05.1.454.light.4.raw
cgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgctagtttattactgtcagcagcgtatcgactggatcaccttcggccaagggacacgactggaaattaacgaactgtggctgcaccatctgtcttcat

SEQ ID NO: 578241 - DNA, 480 bp, Homo sapiens
  misc_feature: HIJSMM301CUUKP.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaaggctggagatcaatcgaa

SEQ ID NO: 578242 - DNA, 508 bp, Homo sapiens
  misc_feature: HIJSMM301DO8G7.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctggtcactctcg

SEQ ID NO: 578243 - DNA, 480 bp, Homo sapiens
  misc_feature: HIJSMM301C87GS.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccaagctgaccgtcctaagtcagacccg

SEQ ID NO: 578244 - DNA, 516 bp, Homo sapiens
  misc_feature: HIJSMM301EXNOX.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgt

SEQ ID NO: 578245 - DNA, 508 bp, Homo sapiens; identical to SEQ ID NO: 545298
  misc_feature: HIJSMM301A76OX.8.42.D09.1.454.light.4.raw

SEQ ID NO: 578246 - DNA, 487 bp, Homo sapiens; identical to SEQ ID NO: 536206
  misc_feature: HIJSMM301EQCDG.47.38.D05.1.454.light.4.raw

SEQ ID NO: 578247 - DNA, 496 bp, Homo sapiens
  misc_feature: HIJSMM301AE1NP.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcacccatctgtcctt

SEQ ID NO: 578248 - DNA, 484 bp, Homo sapiens; identical to SEQ ID NO: 536162
  misc_feature: HIJSMM301DE8C7.13.59.F04.1.454.light.4.raw

SEQ ID NO: 578249 - DNA, 485 bp, Homo sapiens; identical to SEQ ID NO: 568000
  misc_feature: HIJSMM301BXPH8.19.71.G05.1.454.light.4.raw

SEQ ID NO: 578250 - DNA, 506 bp, Homo sapiens; identical to SEQ ID NO: 557726
  misc_feature: HIJSMM301AW7YE.47.83.H06.1.454.light.4.raw

SEQ ID NO: 578251 - DNA, 485 bp, Homo sapiens; identical to SEQ ID NO: 535880
  misc_feature: HIJSMM301A6MXK.7.75.G09.1.454.light.4.raw

SEQ ID NO: 578252 - DNA, 507 bp, Homo sapiens; identical to SEQ ID NO: 561702
  misc_feature: HIJSMM301A6C7S.5.24.C02.1.454.light.4.raw

SEQ ID NO: 578253 - DNA, 474 bp, Homo sapiens
  misc_feature: HIJSMM301CS9KO.51.55.E11.1.454.light.4.raw
cgatcgtatacacgaccggtgctcgatttagcactcgcacgttgggtttgggggaagagctgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattgtgcaatttattactgtcagcagtataataactggcctccgtacacttttggccaggggaccaagctggagatcaaacgaa

SEQ ID NO: 578254 - DNA, 519 bp, Homo sapiens
  misc_feature: HIJSMM301EJ25G.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaggaccgaacggtaggaaggtacaaacgaaacgtagtggcgtgcgaccactctgtcttctatcttcccgtcccact

SEQ ID NO: 578255 - DNA, 491 bp, Homo sapiens
  misc_feature: HIJSMM301ASTO6.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcgtccagggaccgaacggtaggaagtacaaacgaactagtggctgcacca

SEQ ID NO: 578256 - DNA, 445 bp, Homo sapiens; identical to SEQ ID NO: 537719
  misc_feature: HIJSMM301DARHL.47.85.H08.1.454.light.4.raw

SEQ ID NO: 578257 - DNA, 497 bp, Homo sapiens; identical to SEQ ID NO: 536376
  misc_feature: HIJSMM301EN69Z.22.9.A09.1.454.light.4.raw

SEQ ID NO: 578258 - DNA, 490 bp, Homo sapiens
  misc_feature: HIJSMM301BAUVA.49.62.F07.1.454.light.4.raw
agtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaacccca

SEQ ID NO: 578259 - DNA, 498 bp, Homo sapiens
  misc_feature: HIJSMM301CVV6W.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacggagggtgattattactgcagctcatatagaagtggcagcactctcgtattcggcggtgggaccaagctgaccgtcctaggtcagcccaaggcctgccccctc

SEQ ID NO: 578260 - DNA, 475 bp, Homo sapiens
  misc_feature: HIJSMM301BRSX3.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcagggtcccatcaaggttcagtggaagtggatctgggacagattttactttcaccatcaccagcctgcagcctgaagatattgcaacatattactgtcaacagtatgataatctcctcccacttcggcggagggaccaaggtggagatcaaacgaactgtgg

SEQ ID NO: 578261 - DNA, 493 bp, Homo sapiens; identical to SEQ ID NO: 537422
  misc_feature: HIJSMM301BHX3D.9.34.D01.1.454.light.4.raw

SEQ ID NO: 578262 - DNA, 463 bp, Homo sapiens; identical to SEQ ID NO: 535062
  misc_feature: HIJSMM301CTD8H.11.73.G07.1.454.light.4.raw

SEQ ID NO: 578263 - DNA, 497 bp, Homo sapiens; identical to SEQ ID NO: 535664
  misc_feature: HIJSMM301DET69.22.14.B03.1.454.light.4.raw

SEQ ID NO: 578264 - DNA, 494 bp, Homo sapiens
  misc_feature: HIJSMM301A9GNX.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggtgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttcggccaggggacacgactggagattaagcgaactgtggctgcaccatctgtctt

SEQ ID NO: 578265 - DNA, 472 bp, Homo sapiens
  misc_feature: HIJSMM301BINRU.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagtagcctgcagcctgaagattttgcaacttattactgtctacaagatcacaattatcctgggacgttcggccaagggaccaaggtggaaatcaaacgaa

SEQ ID NO: 578266 - DNA, 508 bp, Homo sapiens; identical to SEQ ID NO: 550253
  misc_feature: HIJSMM301EITTB.9.55.E11.1.454.light.4.raw

SEQ ID NO: 578267 - DNA, 469 bp, Homo sapiens
  misc_feature: HIJSMM301ADF8C.18.9.A09.1.454.light.4.raw
  modified_base (429)..(429): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccnccctcctccatacctctgtgcggcggtcgcgacgacggcg

SEQ ID NO: 578268 - DNA, 486 bp, Homo sapiens; identical to SEQ ID NO: 535043
  misc_feature: HIJSMM301BBM46.46.35.D02.1.454.light.4.raw

SEQ ID NO: 578269 - DNA, 505 bp, Homo sapiens; identical to SEQ ID NO: 567186
  misc_feature: HIJSMM301CP7DJ.9.71.G05.1.454.light.4.raw

SEQ ID NO: 578270 - DNA, 487 bp, Homo sapiens
  misc_feature: HIJSMM301BFN3E.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgcaacaatatgatatttattctccagcgttcggccaggggaccaaggtggaagtcaagcgaactgtggctgcaccatctgt

SEQ ID NO: 578271 - DNA, 481 bp, Homo sapiens; identical to SEQ ID NO: 535993
  misc_feature: HIJSMM301DTMRY.21.25.C03.1.454.light.4.raw

SEQ ID NO: 578272 - DNA, 503 bp, Homo sapiens; identical to SEQ ID NO: 568855
  misc_feature: HIJSMM301DNJFW.9.71.G05.1.454.light.4.raw

SEQ ID NO: 578273 - DNA, 473 bp, Homo sapiens
  misc_feature: HIJSMM301BL4U3.13.39.D06.1.454.light.4.raw
tcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaa

SEQ ID NO: 578274 - DNA, 480 bp, Homo sapiens
  misc_feature: HIJSMM301DDSS6.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtacctgctcactttcggcggaggaccaaggtggagatcaaacgaactgtggctgcacc

SEQ ID NO: 578275 - DNA, 503 bp, Homo sapiens; identical to SEQ ID NO: 539976
  misc_feature: HIJSMM301CKSG1.47.55.E11.1.454.light.4.raw

SEQ ID NO: 578276 - DNA, 494 bp, Homo sapiens
  misc_feature: HIJSMM301AQDFN.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcgccaaggaccaaggtggaaatcaaacgaactgtggctgcacc

SEQ ID NO: 578277 - DNA, 485 bp, Homo sapiens; identical to SEQ ID NO: 535880
  misc_feature: HIJSMM301ALYQ5.7.75.G09.1.454.light.4.raw

SEQ ID NO: 578278 - DNA, 496 bp, Homo sapiens; identical to SEQ ID NO: 556037
  misc_feature: HIJSMM301EFKQP.41.38.D05.1.454.light.4.raw

SEQ ID NO: 578279 - DNA, 521 bp, Homo sapiens; identical to SEQ ID NO: 539470
  misc_feature: HIJSMM301AX0O7.27.23.C01.1.454.light.4.raw

SEQ ID NO: 578280 - DNA, 491 bp, Homo sapiens; identical to SEQ ID NO: 535294
  misc_feature: HIJSMM301BI1IS.16.68.G02.1.454.light.4.raw

SEQ ID NO: 578281 - DNA, 492 bp, Homo sapiens
  misc_feature: HIJSMM301B5UFS.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttattctgccagcaatatattactggcctgcgtcgacgttcggccacgggaccaaggtggaaatcaaacgaactgtgctgcaccatctgtctt

SEQ ID NO: 578282 - DNA, 494 bp, Homo sapiens
  misc_feature: HIJSMM301A0MUZ.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactccttacacttttggccaggggaccaagctggagatcaaacgaactgtgg

SEQ ID NO: 578283 - DNA, 502 bp, Homo sapiens; identical to SEQ ID NO: 537363
  misc_feature: HIJSMM301A0SZK.18.23.C01.1.454.light.4.raw

SEQ ID NO: 578284 - DNA, 495 bp, Homo sapiens
  misc_feature: HIJSMM301D1OIB.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacggactggagattaaacgaactgtggctgcaccatctgtctt

SEQ ID NO: 578285 - DNA, 513 bp, Homo sapiens
  misc_feature: HIJSMM301DWTNF.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcggggggaccgacactgaccgtcctaggtcagcccaaggctgccccctcgtcactctgtt

SEQ ID NO: 578286 - DNA, 534 bp, Homo sapiens
  misc_feature: HIJSMM301D7Y8H.52.30.C08.1.454.light.4.raw
cgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcattatttatggtgtcggtgaccggccctcaggggtttcgaatcacttctctggctccaagtccggcaacacggcctccctgaccatctctgggctccaggccgaggacgaggctgattattactgcgcctcatatacaaacaacaacaattgggtgttcggcggagggaccaagctgaccgtcctaggtcagcccaaggctgccccctcggtcactctgttcccaccctcctctatacg

SEQ ID NO: 578287 - DNA, 497 bp, Homo sapiens; identical to SEQ ID NO: 545672
  misc_feature: HIJSMM301B4RJI.2.49.E05.1.454.light.4.raw

SEQ ID NO: 578288 - DNA, 512 bp, Homo sapiens
  misc_feature: HIJSMM301CQ75X.17.2.A02.1.454.light.4.raw
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactggaccaaggtcaccgtcctacgtcagcccaaggccaacccctactcgtcactctgttccccgccctt

SEQ ID NO: 578289 - DNA, 512 bp, Homo sapiens
  misc_feature: HIJSMM301AHZJ7.14.55.E11.1.454.light.4.raw
  modified_base (461)..(461): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctactacgttcggacggacggaccgaggcggatanacgacgaacgtaacgtggtcgtcgtcgaccaacctactcttcgttacctta

SEQ ID NO: 578290 - DNA, 484 bp, Homo sapiens
  misc_feature: HIJSMM301C65PT.46.26.C04.1.454.light.4.raw
  modified_base (476)..(476): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctcggggtccctgacaggttcagtggcagtggatcaggcacagattttacactgaaaatcagcagagtggaggctgaggatgttgggctctattattgcatgcaagctctacaagtcccgctcactttcggcggagggaccaaagtggagatnaaacgaaa

SEQ ID NO: 578291 - DNA, 488 bp, Homo sapiens; identical to SEQ ID NO: 535861
  misc_feature: HIJSMM301B7NX6.14.55.E11.1.454.light.4.raw

SEQ ID NO: 578292 - DNA, 489 bp, Homo sapiens
  misc_feature: HIJSMM301BVOOS.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgctaatttattactgtcagcagtataataactggtggacgttcggccaagggaccaaggtagaaatcaaacgaactgtggctgcaccatctgtt

SEQ ID NO: 578293 - DNA, 518 bp, Homo sapiens
  misc_feature: HIJSMM301ALNA6.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctgccccctggtcactctgttcccgcct

SEQ ID NO: 578294 - DNA, 513 bp, Homo sapiens
  misc_feature: HIJSMM301AZZVA.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatcctccaacctccagtctgacgatgaggctgagtatcactgtggagagagccacacaattgatggccaagacggttgggtgttcggcggagggaccaagctgaccgtcctaggtcagcccaaggctgccccctcggtcactctcgttcccaccctcctcgctacgt

SEQ ID NO: 578295 - DNA, 516 bp, Homo sapiens
  misc_feature: HIJSMM301CY9U8.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcgggcggagggaccaagctgaccgtcctaggtcagcccaaggctgccccctggtcactctgttccccacctcctcgctacgtagacg

SEQ ID NO: 578296 - DNA, 474 bp, Homo sapiens
  misc_feature: HIJSMM301EGHO6.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaactttacactgtcagcagtcttacagtaggccgggcacctttggccaggggacgaagctggagatcgaacgaactgtggctgcaccatctgtcttcatccttcccgccatctgagacacgcgag

SEQ ID NO: 578297 - DNA, 504 bp, Homo sapiens
  misc_feature: HIJSMM301BNWR8.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaataagaggtcaaacgaaactgtggctgcaccatctgtcttcatt

SEQ ID NO: 578298 - DNA, 469 bp, Homo sapiens
  misc_feature: HIJSMM301B48G6.3.68.G02.1.454.light.4.raw
agacgcactccacgaccggtgctcgatttagtcgatagtgaagggaaaggggaggtcagtctcagtcaggacacagcatggacatgagggtccccgcctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaagcccctaagctcctgatctatgctgcatccactttgcatggtggggtcccatcaagcttcagtggcagtggatctgggacagatttcactctcaccatcagcaatctgcaacctgaagattttgcaacttactactgtcaacagagttacagtacccctccgacttttggccaggggaccaagctggagatcaaacgaa

SEQ ID NO: 578299 - DNA, 498 bp, Homo sapiens; identical to SEQ ID NO: 569811
  misc_feature: HIJSMM301BJMSZ.18.11.A11.1.454.light.4.raw

SEQ ID NO: 578300 - DNA, 491 bp, Homo sapiens
  misc_feature: HIJSMM301BULP5.5.57.F02.1.454.light.4.raw
  modified_base (479)..(479): a, c, t, g, unknown or other
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggccagggaccacatggatatcaggcgaactgtggctgnaccatctgtctt

SEQ ID NO: 578301 - DNA, 476 bp, Homo sapiens
  misc_feature: HIJSMM301C5TIP.14.5.A05.1.454.light.4.raw
cgtctagtaccacgaccggtgctcgatttagatagatagacagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccatctgtcttcatccttccgccat

SEQ ID NO: 578302 - DNA, 515 bp, Homo sapiens
  misc_feature: HIJSMM301EMTSX.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccacctcctcacg

SEQ ID NO: 578303 - DNA, 496 bp, Homo sapiens
  misc_feature: HIJSMM301BYRDW.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggcccaagggacacgactggagattaaacgaactagtggctgcaccatctgtctt

SEQ ID NO: 578304 - DNA, 513 bp, Homo sapiens; identical to SEQ ID NO: 535244
  misc_feature: HIJSMM301ADMRG.17.33.C11.1.454.light.4.raw

SEQ ID NO: 578305 - DNA, 447 bp, Homo sapiens; identical to SEQ ID NO: 535201
  misc_feature: HIJSMM301ATAKO.18.9.A09.1.454.light.4.raw

SEQ ID NO: 578306 - DNA, 518 bp, Homo sapiens; identical to SEQ ID NO: 539372
  misc_feature: HIJSMM301CO95Z.7.86.H09.1.454.light.4.raw

SEQ ID NO: 578307 - DNA, 504 bp, Homo sapiens; identical to SEQ ID NO: 539690
  misc_feature: HIJSMM301AYHDE.47.65.F10.1.454.light.4.raw

SEQ ID NO: 578308 - DNA, 492 bp, Homo sapiens; identical to SEQ ID NO: 536087
  misc_feature: HIJSMM301B5ALM.10.17.B06.1.454.light.4.raw

SEQ ID NO: 578309 - DNA, 518 bp, Homo sapiens
  misc_feature: HIJSMM301BDNG9.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagccgtgtggggcaggtcagcccaaggctgccccctcggtcactctgtcccaccctcctccacg

SEQ ID NO: 578310 - DNA, 502 bp, Homo sapiens
  misc_feature: HIJSMM301CZQX8.41.87.H10.1.454.light.4.raw
tctatactatcacgaccggtgctcgatttagcagtactgcgttgggtttgggactttgcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgttcccgccctcctccatagtataga

SEQ ID NO: 578311 - DNA, 478 bp, Homo sapiens
  misc_feature: HIJSMM301BWCHY.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtatttcggccctgggaccacagtagatatcaaacgaactgtggctgcacc

SEQ ID NO: 578312 - DNA, 482 bp, Homo sapiens
  misc_feature: HIJSMM301ADU5I.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcccgccatctgctatctacg

SEQ ID NO: 578313 - DNA, 491 bp, Homo sapiens
  misc_feature: HIJSMM301BFFJY.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgctcatatgcaggtggtactacttgggtgttcggcagagggaccaagctgaccgtcctaggtcagaccccg

SEQ ID NO: 578314 - DNA, 460 bp, Homo sapiens; identical to SEQ ID NO: 537107
  misc_feature: HIJSMM301BSNSA.22.28.C06.1.454.light.4.raw

SEQ ID NO: 578315 - DNA, 486 bp, Homo sapiens; identical to SEQ ID NO: 535043
  misc_feature: HIJSMM301AR55T.46.35.D02.1.454.light.4.raw

SEQ ID NO: 578316 - DNA, 488 bp, Homo sapiens; identical to SEQ ID NO: 539612
  misc_feature: HIJSMM301BY1W4.3.55.E11.1.454.light.4.raw

SEQ ID NO: 578317 - DNA, 484 bp, Homo sapiens; identical to SEQ ID NO: 537891
  misc_feature: HIJSMM301CIW56.10.1.A01.1.454.light.4.raw

SEQ ID NO: 578318 - DNA, 499 bp, Homo sapiens
  misc_feature: HIJSMM301CWEYA.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccgtaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 578319 - DNA, 517 bp, Homo sapiens
  misc_feature: HIJSMM301CT4JL.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatctccccg

SEQ ID NO: 578320 - DNA, 482 bp, Homo sapiens; identical to SEQ ID NO: 535352
  misc_feature: HIJSMM301CVWXJ.16.81.H04.1.454.light.4.raw

SEQ ID NO: 578321 - DNA, 493 bp, Homo sapiens; identical to SEQ ID NO: 536769
  misc_feature: HIJSMM301C6MOC.19.83.H06.1.454.light.4.raw

SEQ ID NO: 578322 - DNA, 494 bp, Homo sapiens
  misc_feature: HIJSMM301CQGQL.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcgccaagggacacgactggagattaaaaggaactgtggctgcaccatctgtcttcatcttccccg

SEQ ID NO: 578323 - DNA, 486 bp, Homo sapiens; identical to SEQ ID NO: 535043
  misc_feature: HIJSMM301B9YRM.46.35.D02.1.454.light.4.raw

SEQ ID NO: 578324 - DNA, 508 bp, Homo sapiens; identical to SEQ ID NO: 552440
  misc_feature: HIJSMM301BB00P.5.24.C02.1.454.light.4.raw

SEQ ID NO: 578325 - DNA, 486 bp, Homo sapiens; identical to SEQ ID NO: 535458
  misc_feature: HIJSMM301BNKDX.7.75.G09.1.454.light.4.raw

SEQ ID NO: 578326 - DNA, 489 bp, Homo sapiens
  misc_feature: HIJSMM301BHNL1.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaaactcctctcactttcggcggagggaccgaaggtggagatcaaacgaactgt

SEQ ID NO: 578327 - DNA, 511 bp, Homo sapiens
  misc_feature: HIJSMM301ATZPI.10.28.C06.1.454.light.4.raw
catagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccacactgaccgtcctaggtcagcccaaggctgccccctcggtcactctgtt

SEQ ID NO: 578328 - DNA, 512 bp, Homo sapiens
  misc_feature: HIJSMM301BQC27.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcggccgaagggaccgaacggtagggacgatacaagcgaacctgtggctgcaccatctgttcttcatcttcccgtcccact

SEQ ID NO: 578329 - DNA, 447 bp, Homo sapiens; identical to SEQ ID NO: 535020
  misc_feature: HIJSMM301CNED1.18.9.A09.1.454.light.4.raw

SEQ ID NO: 578330 - DNA, 484 bp, Homo sapiens
  misc_feature: HIJSMM301BLW5O.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgact

SEQ ID NO: 578331 - DNA, 501 bp, Homo sapiens; identical to SEQ ID NO: 536867
  misc_feature: HIJSMM301AOSI0.5.86.H09.1.454.light.4.raw

SEQ ID NO: 578332 - DNA, 499 bp, Homo sapiens; identical to SEQ ID NO: 535698
  misc_feature: HIJSMM301BV9Z0.12.86.H09.1.454.light.4.raw

SEQ ID NO: 578333 - DNA, 361 bp, Homo sapiens; identical to SEQ ID NO: 544890
  misc_feature: HIJSMM301CY8TF.3.57.F02.1.454.light.4.raw

SEQ ID NO: 578334 - DNA, 494 bp, Homo sapiens
  misc_feature: HIJSMM301CSAMU.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaacgaactgtggctgcaccatctgtcttcatt

SEQ ID NO: 578335 - DNA, 479 bp, Homo sapiens; identical to SEQ ID NO: 546627
  misc_feature: HIJSMM301DGSG7.11.11.A11.1.454.light.4.raw

SEQ ID NO: 578336 - DNA, 498 bp, Homo sapiens
  misc_feature: HIJSMM301CIGR7.51.9.A09.1.454.light.4.raw
cgatcgtatacacgaccggtgctcgatttagcgagacgcgcagggggcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggatttactcatctctgggctccagtctgaggatgaggctgactattactgtttgatttggcacagcagcgcttgggtattcggcgggggaccgaaactgaccgtcctaggtcagccaaggctgcccctcggtcc

SEQ ID NO: 578337 - DNA, 500 bp, Homo sapiens
  misc_feature: HIJSMM301C3HIS.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagttttattactgtcagcaatactatagtcctcctctcacgttcggcggagggaccaaggtggagatcaaacgaactgtggctgcaccatctgtcttcatcttcccgccatctgacta

SEQ ID NO: 578338 - DNA, 473 bp, Homo sapiens; identical to SEQ ID NO: 535262
  misc_feature: HIJSMM301CW400.8.67.G01.1.454.light.4.raw

SEQ ID NO: 578339 - DNA, 518 bp, Homo sapiens
  misc_feature: HIJSMM301DIDPE.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttgaaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagccaaggctcgcccctcggtcactctgttcccacct

SEQ ID NO: 578340 - DNA, 495 bp, Homo sapiens; identical to SEQ ID NO: 536055
  misc_feature: HIJSMM301AUAKQ.47.38.D05.1.454.light.4.raw

SEQ ID NO: 578341 - DNA, 476 bp, Homo sapiens
  misc_feature: HIJSMM301EHJY1.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgttggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaac

SEQ ID NO: 578342 - DNA, 493 bp, Homo sapiens
  misc_feature: HIJSMM301CRVF6.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccgcctcctcgctacgtaga

SEQ ID NO: 578343 - DNA, 518 bp, Homo sapiens
  misc_feature: HIJSMM301EQDDV.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgtccgaaggaccgaacggtaggaaggtacgaaacgaaactagtggctgcaccaactctgtcttctactcttcccgtccact

SEQ ID NO: 578344 - DNA, 493 bp, Homo sapiens
  misc_feature: HIJSMM301AK5KL.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagataaacgaactgtggctgcaccatctgtctt

SEQ ID NO: 578345 - DNA, 485 bp, Homo sapiens
  misc_feature: HIJSMM301BEAJ8.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccgaacggtaggaaagtacaaacgaactagtgg

SEQ ID NO: 578346 - DNA, 375 bp, Homo sapiens; identical to SEQ ID NO: 537938
  misc_feature: HIJSMM301CGFIH.9.11.A11.1.454.light.4.raw

SEQ ID NO: 578347 - DNA, 497 bp, Homo sapiens
  misc_feature: HIJSMM301AZCU5.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatacaaacgaaactgtggctgcaccatctgtcttcatt

SEQ ID NO: 578348 - DNA, 490 bp, Homo sapiens
  misc_feature: HIJSMM301D0CGK.26.12.B01.1.454.light.4.raw
  modified_base (415)..(415): a, c, t, g, unknown or other
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattacngtcagcaatataattactgctctctttcgcgggggccgaagctggagatcaaccgaactgtgcgtgcaccactct

SEQ ID NO: 578349 - DNA, 510 bp, Homo sapiens
  misc_feature: HIJSMM301CY5QA.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccgaaggtggaggatcaaacgaactgtggctgcaccatctgtcttcta

SEQ ID NO: 578350 - DNA, 507 bp, Homo sapiens; identical to SEQ ID NO: 540930
  misc_feature: HIJSMM301CEUQX.8.34.D01.1.454.light.4.raw

SEQ ID NO: 578351 - DNA, 508 bp, Homo sapiens; identical to SEQ ID NO: 540933
  misc_feature: HIJSMM301B5LPU.13.4.A04.1.454.light.4.raw

SEQ ID NO: 578352 - DNA, 502 bp, Homo sapiens; identical to SEQ ID NO: 536253
  misc_feature: HIJSMM301CYQFN.21.22.B11.1.454.light.4.raw

SEQ ID NO: 578353 - DNA, 507 bp, Homo sapiens; identical to SEQ ID NO: 563344
  misc_feature: HIJSMM301A8ZVK.3.79.H02.1.454.light.4.raw

SEQ ID NO: 578354 - DNA, 486 bp, Homo sapiens; identical to SEQ ID NO: 535043
  misc_feature: HIJSMM301BQVF3.46.35.D02.1.454.light.4.raw

SEQ ID NO: 578355 - DNA, 504 bp, Homo sapiens
  misc_feature: HIJSMM301CI8SH.43.38.D05.1.454.light.4.raw
tgtgagtagtcacgaccggtgctcgatttagtatctgatagttgggtttggggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtccctcaaggttcagcggcagtgcatctgggacagatttcactctcaccatcagcagcctgcagcctgatgattttgcaacttattactgtcaacagtataatagttacccctggacgttcggccaagggaccagggtggaaatcaaacgaact

SEQ ID NO: 578356 - DNA, 510 bp, Homo sapiens; identical to SEQ ID NO: 537801
  misc_feature: HIJSMM301BOFAA.5.60.F05.1.454.light.4.raw

SEQ ID NO: 578357 - DNA, 507 bp, Homo sapiens
  misc_feature: HIJSMM301BNVEG.40.67.G01.1.454.light.4.raw
tctagcgactcacgaccggtgctcgatttagagtatacatattgggtttggggagagccctggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgactgtggctgcaccatctgtcttcatt

SEQ ID NO: 578358 - DNA, 521 bp, Homo sapiens
  misc_feature: HIJSMM301EZU5C.41.55.E11.1.454.light.4.raw
tctatactatcacgaccggtgctcgatttagcactcgcacgttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctcgttcccgccctcctca

SEQ ID NO: 578359 - DNA, 513 bp, Homo sapiens; identical to SEQ ID NO: 555055
  misc_feature: HIJSMM301C6F1J.15.76.G10.1.454.light.4.raw

SEQ ID NO: 578360 - DNA, 515 bp, Homo sapiens
  misc_feature: HIJSMM301CY5V3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtcaacggaccgaacggtaggaagtacgaaacgaactacgtggctgcaccactctgtcttctactcttccgtccact

SEQ ID NO: 578361 - DNA, 504 bp, Homo sapiens
  misc_feature: HIJSMM301ASXBW.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtgggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactagtggctgcaccatctgtcttcatctcccgccat

SEQ ID NO: 578362 - DNA, 486 bp, Homo sapiens
  misc_feature: HIJSMM301COA9T.41.50.E06.1.454.light.4.raw
tctatactatcacgaccggtgctcgatttagatctactgacaacacacaaggggtgatcaggactcctcagttcaccttctcacaatgaggctccctgctcagctcctggggctgctaatgctctgggtctctggatccactggggctgttgtgatgacacagtctccactctccctgcccatcacccctggcgagccggcctccatctcctgtaggtctagtctgagcctcctgtctagtagtggagacaactatttggattggtacctgcagaagccagggcagtctccacaactcctgatttatttgggttttcatcgggcctccggggtccctgacaggttcagtggcagtggatcaggcacagattttacactgagtatcagcacagtggaggctgaggatgttggggtttattattgtgtgcaaactctacactccacgtggacgttcggccacgggacgagggtggatatacaaacgaa

SEQ ID NO: 578363 - DNA, 498 bp, Homo sapiens
  misc_feature: HIJSMM301BL3AN.51.53.E09.1.454.light.4.raw
cgatcgtatacacgaccggtgctcgatttagagagagtgtgttgggtttggggggccgtcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtccaggcccaaggctcgccccctccggtcacct

SEQ ID NO: 578364 - DNA, 506 bp, Homo sapiens
  misc_feature: HIJSMM301CIZOP.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtggatatcaaacgaactgtggctgcaccactctgtt

SEQ ID NO: 578365 - DNA, 485 bp, Homo sapiens; identical to SEQ ID NO: 539041
  misc_feature: HIJSMM301EDTD9.46.26.C04.1.454.light.4.raw

SEQ ID NO: 578366 - DNA, 516 bp, Homo sapiens
  misc_feature: HIJSMM301DCSR4.52.20.B09.1.454.light.4.raw
cgcagtacgacacgaccggtgctcgatttagtgtagtgtgaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcccctgcactggaaccagcggtgacattggtggttataactatgtctcctggtaccaacaccacccaggcaaagcccccaaactcatgatttatgatatcagtgatcggccctcaggggtttcgaatcgcttctctggctccaagtccggcaacacggcctccctgaccatctctgggctccaggccgaggacgaggctgattattattgcagctcatatacaaacaacaacaattgggtgttcggcggagggaccaagctgaccgtcctaggtcagcccaaggctgccccctggtcactctgttccccacctcct

SEQ ID NO: 578367 - DNA, 505 bp, Homo sapiens; identical to SEQ ID NO: 535503
  misc_feature: HIJSMM301AJNLP.8.28.C06.1.454.light.4.raw

SEQ ID NO: 578368 - DNA, 329 bp, Homo sapiens
  misc_feature: HIJSMM301BWJG0.49.83.H06.1.454.light.4.raw
agtcgagagacacgaccggtgctcgatttagatcacgtgcgtcgcgggtggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggctagatatcggacgaactgtggctgcaccatctgtcttcatcttcccgccatctgatctctcgact

SEQ ID NO: 578369 - DNA, 473 bp, Homo sapiens
  misc_feature: HIJSMM301CGF6R.51.77.G11.1.454.light.4.raw
cgatcgtatacacgaccggtgctcgatttagctagtcactcaagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggaggaccaagctgaccgtcctcggtcagccc

SEQ ID NO: 578370 - DNA, 501 bp, Homo sapiens; identical to SEQ ID NO: 535746
  misc_feature: HIJSMM301CWYWO.18.11.A11.1.454.light.4.raw

SEQ ID NO: 578371 - DNA, 504 bp, Homo sapiens; identical to SEQ ID NO: 538940
  misc_feature: HIJSMM301C2EL8.2.35.D02.1.454.light.4.raw

SEQ ID NO: 578372 - DNA, 476 bp, Homo sapiens; identical to SEQ ID NO: 537368
  misc_feature: HIJSMM301AF4XZ.7.83.H06.1.454.light.4.raw

SEQ ID NO: 578373 - DNA, 487 bp, Homo sapiens; identical to SEQ ID NO: 536536
  misc_feature: HIJSMM301DMMH4.26.45.E01.1.454.light.4.raw

SEQ ID NO: 578374 - DNA, 488 bp, Homo sapiens; identical to SEQ ID NO: 535081
  misc_feature: HIJSMM301C68J6.26.23.C01.1.454.light.4.raw

SEQ ID NO: 578375 - DNA, 509 bp, Homo sapiens; identical to SEQ ID NO: 566851
  misc_feature: HIJSMM301DH4IK.51.86.H09.1.454.light.4.raw

SEQ ID NO: 578376 - DNA, 484 bp, Homo sapiens; identical to SEQ ID NO: 535400
  misc_feature: HIJSMM301BXPJA.46.26.C04.1.454.light.4.raw

SEQ ID NO: 578377 - DNA, 488 bp, Homo sapiens
  misc_feature: HIJSMM301CCD7H.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcacttattactgccaacaatatgatatttattctccagcgttcggccaggggaccaaggtggaagtcaagcgaactgtggctgcaccatctgtt

SEQ ID NO: 578378 - DNA, 472 bp, Homo sapiens; identical to SEQ ID NO: 540871
  misc_feature: HIJSMM301D5AXA.13.48.E04.1.454.light.4.raw

SEQ ID NO: 578379 - DNA, 518 bp, Homo sapiens
  misc_feature: HIJSMM301DK3KV.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagccaaggctgccccctcggtcactctgttcccgcct

SEQ ID NO: 578380 - DNA, 484 bp, Homo sapiens; identical to SEQ ID NO: 567017
  misc_feature: HIJSMM301DC0SQ.19.5.A05.1.454.light.4.raw

SEQ ID NO: 578381 - DNA, 441 bp, Homo sapiens; identical to SEQ ID NO: 534971
  misc_feature: HIJSMM301EM4PV.11.3.A03.1.454.light.4.raw

SEQ ID NO: 578382 - DNA, 495 bp, Homo sapiens
  misc_feature: HIJSMM301CWOWJ.9.50.E06.1.454.light.4.raw
tgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggtccgaacgggaccgaaagtaggacgatcaagcgaactgtggcgtgcgaccat

SEQ ID NO: 578383 - DNA, 491 bp, Homo sapiens; identical to SEQ ID NO: 536211
  misc_feature: HIJSMM301DE660.16.53.E09.1.454.light.4.raw

SEQ ID NO: 578384 - DNA, 500 bp, Homo sapiens
  misc_feature: HIJSMM301DA2HG.10.63.F08.1.454.light.4.raw
catagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaagagccaccctctcctgcagggccagtcagagtgtttcccgctacttagcctggtaccaacagaagcctggccaggctcccaggctcctcatgtatgatgcatccaacagggccactggcatcccagccaggttcagtggcagtgggtctgcgacagacttcactctcaccatcaacagcctagaacctgaagattttgcactttatttctgtcaccagagtcgcaactggcctccgacgttcggccaggggaccgaacggtggaggatcagacgaactgtggctgcaccatctgtcttcatcttcccgt

SEQ ID NO: 578385 - DNA, 510 bp, Homo sapiens; identical to SEQ ID NO: 535474
  misc_feature: HIJSMM301C5EXD.17.33.C11.1.454.light.4.raw

SEQ ID NO: 578386 - DNA, 501 bp, Homo sapiens
  misc_feature: HIJSMM301EITEN.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtcactctgttcccgccctccctccacgagtacgta

SEQ ID NO: 578387 - DNA, 473 bp, Homo sapiens
  misc_feature: HIJSMM301CGIU1.52.4.A04.1.454.light.4.raw
  modified_base (469)..(469): a, c, t, g, unknown or other
cgcagtacgacacgaccggtgctcgatttagagtagtgatcagggcacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagtgggacccaggctatggatgaggctgactattactgtcagccgtgggacagaagcactctggtgttcggnggac

SEQ ID NO: 578388 - DNA, 496 bp, Homo sapiens; identical to SEQ ID NO: 537925
  misc_feature: HIJSMM301AQ10O.22.14.B03.1.454.light.4.raw

SEQ ID NO: 578389 - DNA, 512 bp, Homo sapiens
  misc_feature: HIJSMM301CLNHD.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggaggactagaactttgctattcggcggagggaccaagttgaccgtcctaagtcagcccaaggctgccccctcggtcactctgtt

SEQ ID NO: 578390 - DNA, 506 bp, Homo sapiens
  misc_feature: HIJSMM301A8JB7.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactt

SEQ ID NO: 578391 - DNA, 516 bp, Homo sapiens
  misc_feature: HIJSMM301DLNIL.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgtacttactattgtcaacagacgttaccttctcccccggacgttcggtccgaacggaccgaaggtacggaaagtactaagacgaactagtggctgcaccatctgtcttctactcttcccgt

SEQ ID NO: 578392 - DNA, 502 bp, Homo sapiens
  misc_feature: HIJSMM301AY5NC.19.78.H01.1.454.light.4.raw
tactctcgtgcacgaccggtgctcgatttagtgtgagtagtttgggtttgggggtcacaagaggcagcgctctcgggacgtctccaccatagcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 578393 - DNA, 492 bp, Homo sapiens
  misc_feature: HIJSMM301B7EAY.48.57.F02.1.454.light.4.raw
agtatacatacacgaccggtgctcgatttagctcgatatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggaggaccaagctgacagtcctaggtcagcccaaggctcgtcccccg

SEQ ID NO: 578394 - DNA, 505 bp, Homo sapiens; identical to SEQ ID NO: 538422
  misc_feature: HIJSMM301ED8BB.19.78.H01.1.454.light.4.raw

SEQ ID NO: 578395 - DNA, 460 bp, Homo sapiens; identical to SEQ ID NO: 549551
  misc_feature: HIJSMM301AME8J.48.73.G07.1.454.light.4.raw

SEQ ID NO: 578396 - DNA, 480 bp, Homo sapiens
  misc_feature: HIJSMM301ATURJ.51.77.G11.1.454.light.4.raw
cgatcgtatacacgaccggtgctcgatttagctagtcactcaagggaaaggggaggagtcagtcccaaccaggacacaacatggacatgagggtccctgctcagctcctggggctcctgctgctctggctctcaggtggcagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacattttcactctcaccatcagcagcctgcagcctgacgatgttgcaacttattactgtcaaaattataacagggccgttgcgctcactttcggcggggggaccgaaggtggagatcaagcgaactgt

SEQ ID NO: 578397 - DNA, 494 bp, Homo sapiens; identical to SEQ ID NO: 534992
  misc_feature: HIJSMM301AUIPM.9.1.A01.1.454.light.4.raw

SEQ ID NO: 578398 - DNA, 494 bp, Homo sapiens
  misc_feature: HIJSMM301DOEYC.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctggacttttggccaggggaccaagctggagatcaaacgaactgtggctgcaccatctgtctt

SEQ ID NO: 578399 - DNA, 496 bp, Homo sapiens; identical to SEQ ID NO: 535109
  misc_feature: HIJSMM301CIZOC.16.78.H01.1.454.light.4.raw

SEQ ID NO: 578400 - DNA, 488 bp, Homo sapiens; identical to SEQ ID NO: 535990
  misc_feature: HIJSMM301DH7Q7.11.28.C06.1.454.light.4.raw

SEQ ID NO: 578401 - DNA, 488 bp, Homo sapiens
  misc_feature: HIJSMM301CXMDY.51.28.C06.1.454.light.4.raw
cgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagccaaggctgcccctcggt

SEQ ID NO: 578402 - DNA, 518 bp, Homo sapiens; identical to SEQ ID NO: 539372
  misc_feature: HIJSMM301ENXPU.7.86.H09.1.454.light.4.raw

SEQ ID NO: 578403 - DNA, 484 bp, Homo sapiens
  misc_feature: HIJSMM301DHEWP.52.44.D11.1.454.light.4.raw
cgcagtacgacacgaccggtgctcgatttagcgcagtacgaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgctctggaaccagcagtgatgttggtaactataactctgtctcctggtaccaacagcacccaggcaaagccccccaactcataattcatgatgtcactaagcggccctcaggggtccctggtcgtttctctgcctccaagtctggcaacacggcctccctgaccatctctgggctccaggctgaggatgaggctgattattactgctgctcatatgcaggcagcaacacttatgtcttcggaactgggaccaaggtcaccgtctaggtcagcccaa

SEQ ID NO: 578404 - DNA, 454 bp, Homo sapiens
  misc_feature: HIJSMM301DET20.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctccgtcactctgttcccaccctcctccaccgagagta

SEQ ID NO: 578405 - DNA, 496 bp, Homo sapiens; identical to SEQ ID NO: 536248
  misc_feature: HIJSMM301BGGYB.22.27.C05.1.454.light.4.raw

SEQ ID NO: 578406 - DNA, 471 bp, Homo sapiens
  misc_feature: HIJSMM301DTQSL.49.8.A08.1.454.light.4.raw
agtcgagagacacgaccggtgctcgatttagcatactctacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattaactgtcaacagtatgatagtctcccgctcactttcggcggagggaccaaggtggagatcaaacgaactgt

SEQ ID NO: 578407 - DNA, 486 bp, Homo sapiens; identical to SEQ ID NO: 537310
  misc_feature: HIJSMM301CJI5P.15.28.C06.1.454.light.4.raw

SEQ ID NO: 578408 - DNA, 486 bp, Homo sapiens
  misc_feature: HIJSMM301DP1BY.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaacgaa

SEQ ID NO: 578409 - DNA, 492 bp, Homo sapiens; identical to SEQ ID NO: 573597
  misc_feature: HIJSMM301BB8B4.10.72.G06.1.454.light.4.raw

SEQ ID NO: 578410 - DNA, 508 bp, Homo sapiens
  misc_feature: HIJSMM301A8DA6.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctcggtcact

SEQ ID NO: 578411 - DNA, 517 bp, Homo sapiens
  misc_feature: HIJSMM301C4Q8Q.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataacaattatgtgataattggcggagggaccagggtgaccgtcctaggtcagcccaaggctgccccctcggtcactctgttccca

SEQ ID NO: 578412 - DNA, 475 bp, Homo sapiens
  misc_feature: HIJSMM301C5M8V.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgacccttcggccaagggatacgaactggagattaaacgaa

SEQ ID NO: 578413 - DNA, 489 bp, Homo sapiens
  misc_feature: HIJSMM301CJA38.26.23.C01.1.454.light.4.raw
agactatactcacgaccggtgctcgatttagtacacgtgattagggattgggggagtcagacccagtcaggacacagcatgggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcaccatctgt

SEQ ID NO: 578414 - DNA, 495 bp, Homo sapiens; identical to SEQ ID NO: 549993
  misc_feature: HIJSMM301BG3J3.13.6.A06.1.454.light.4.raw

SEQ ID NO: 578415 - DNA, 503 bp, Homo sapiens; identical to SEQ ID NO: 536834
  misc_feature: HIJSMM301CZ3ZZ.2.35.D02.1.454.light.4.raw

SEQ ID NO: 578416 - DNA, 520 bp, Homo sapiens
  misc_feature: HIJSMM301A4E0Y.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactttgttcccaccctcctcctacg

SEQ ID NO: 578417 - DNA, 498 bp, Homo sapiens
  misc_feature: HIJSMM301AG9EV.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatctgaca

SEQ ID NO: 578418 - DNA, 494 bp, Homo sapiens
  misc_feature: HIJSMM301B5K59.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctggggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 578419 - DNA, 501 bp, Homo sapiens; identical to SEQ ID NO: 559918
  misc_feature: HIJSMM301CKYN6.11.31.C09.1.454.light.4.raw

SEQ ID NO: 578420 - DNA, 496 bp, Homo sapiens
  misc_feature: HIJSMM301DX1I4.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcggattcgtctagggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 578421 - DNA, 489 bp, Homo sapiens
  misc_feature: HIJSMM301DNQPD.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcacttttcggcggagggaccaaggttgagatcaaacgaactagtggctgcacc

SEQ ID NO: 578422 - DNA, 498 bp, Homo sapiens; identical to SEQ ID NO: 538742
  misc_feature: HIJSMM301AQ1BO.43.25.C03.1.454.light.4.raw

SEQ ID NO: 578423 - DNA, 500 bp, Homo sapiens; identical to SEQ ID NO: 539795
  misc_feature: HIJSMM301EVJ1E.22.38.D05.1.454.light.4.raw

SEQ ID NO: 578424 - DNA, 445 bp, Homo sapiens; identical to SEQ ID NO: 537719
  misc_feature: HIJSMM301A1TC9.47.85.H08.1.454.light.4.raw

SEQ ID NO: 578425 - DNA, 463 bp, Homo sapiens
  misc_feature: HIJSMM301CCD2D.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggaggaccaaggtggagata

SEQ ID NO: 578426 - DNA, 444 bp, Homo sapiens; identical to SEQ ID NO: 535027
  misc_feature: HIJSMM301A505T.8.73.G07.1.454.light.4.raw

SEQ ID NO: 578427 - DNA, 499 bp, Homo sapiens
  misc_feature: HIJSMM301C7FNU.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattgccgatcaccttcggccaagggacacgactggagattaaacgaactgtggctgcaccatctgtcttcatcttcccgccat

SEQ ID NO: 578428 - DNA, 475 bp, Homo sapiens; identical to SEQ ID NO: 545253
  misc_feature: HIJSMM301DVGOQ.51.67.G01.1.454.light.4.raw

SEQ ID NO: 578429 - DNA, 513 bp, Homo sapiens
  misc_feature: HIJSMM301BFO4L.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcgggagggacaagctgccgtacctagtcacgaccgaaggctccgcccctcggtcactcttccgg

SEQ ID NO: 578430 - DNA, 485 bp, Homo sapiens
  misc_feature: HIJSMM301B0NEL.49.60.F05.1.454.light.4.raw
agtcgagagacacgaccggtgctcgatttagtacgtcatcagggaaaggggactgatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatcaaacg

SEQ ID NO: 578431 - DNA, 487 bp, Homo sapiens; identical to SEQ ID NO: 535583
  misc_feature: HIJSMM301BARGG.22.73.G07.1.454.light.4.raw

SEQ ID NO: 578432 - DNA, 484 bp, Homo sapiens
  misc_feature: HIJSMM301A5ZKE.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaaacgaactgtggctgcaccatctgtt

SEQ ID NO: 578433 - DNA, 488 bp, Homo sapiens
  misc_feature: HIJSMM301BDF1U.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtgggtcccctcaaggttcagcggcagtggatctgggacagatttcactctcgccatcagcagcctgcagactgaagattttgcaacttattttgtcaacaggctaacactttccccctcactttcggcggaggaccaaggtggagatcaagcgaactgtggctgcaccatctgtctt

SEQ ID NO: 578434 - DNA, 486 bp, Homo sapiens; identical to SEQ ID NO: 563598
  misc_feature: HIJSMM301ELCC3.14.53.E09.1.454.light.4.raw

SEQ ID NO: 578435 - DNA, 514 bp, Homo sapiens
  misc_feature: HIJSMM301C5DWC.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggcctgccccctcggtcact

SEQ ID NO: 578436 - DNA, 521 bp, Homo sapiens; identical to SEQ ID NO: 538715
  misc_feature: HIJSMM301BSEGG.27.23.C01.1.454.light.4.raw

SEQ ID NO: 578437 - DNA, 480 bp, Homo sapiens
  misc_feature: HIJSMM301EZOGK.51.60.F05.1.454.light.4.raw
  modified_base (404)..(404): a, c, t, g, unknown or other
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttacngtcaggcgtgggacagcgacactgccgtgttcggcggagggaccaagctgaccgtcctcggtcagcccaaggctcg

SEQ ID NO: 578438 - DNA, 502 bp, Homo sapiens
  misc_feature: HIJSMM301CZ64A.41.14.B03.1.454.light.4.raw
tctatactatcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgacccatctctgggctccaggctgaggacgaggctgattattactgcagctcatatacaagcagcagcactctcgtggtattcggcggagggaccaagctgaccgtcctaggtcagcccaaggctgccccctc

SEQ ID NO: 578439 - DNA, 507 bp, Homo sapiens
  misc_feature: HIJSMM301ASSN5.48.38.D05.1.454.light.4.raw
agtatacatacacgaccggtgctcgatttagtatctgatagttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctgttccccg

SEQ ID NO: 578440 - DNA, 447 bp, Homo sapiens; identical to SEQ ID NO: 535020
  misc_feature: HIJSMM301CLLZ3.18.9.A09.1.454.light.4.raw

SEQ ID NO: 578441 - DNA, 485 bp, Homo sapiens
  misc_feature: HIJSMM301C8YUG.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaattcggtgaggaccaggtggagtcaacgaactgtggctgcaccatctgtcttcatt

SEQ ID NO: 578442 - DNA, 482 bp, Homo sapiens; identical to SEQ ID NO: 544520
  misc_feature: HIJSMM301BHAEN.49.28.C06.1.454.light.4.raw

SEQ ID NO: 578443 - DNA, 486 bp, Homo sapiens; identical to SEQ ID NO: 554172
  misc_feature: HIJSMM301BNQ6P.19.71.G05.1.454.light.4.raw

SEQ ID NO: 578444 - DNA, 487 bp, Homo sapiens; identical to SEQ ID NO: 536206
  misc_feature: HIJSMM301AD5QA.47.38.D05.1.454.light.4.raw

SEQ ID NO: 578445 - DNA, 463 bp, Homo sapiens; identical to SEQ ID NO: 536186
  misc_feature: HIJSMM301BOJC7.51.83.H06.1.454.light.4.raw

SEQ ID NO: 578446 - DNA, 445 bp, Homo sapiens; identical to SEQ ID NO: 575615
  misc_feature: HIJSMM301CJSPG.10.76.G10.1.454.light.4.raw

SEQ ID NO: 578447 - DNA, 494 bp, Homo sapiens; identical to SEQ ID NO: 549057
  misc_feature: HIJSMM301DMJSF.10.33.C11.1.454.light.4.raw

SEQ ID NO: 578448 - DNA, 490 bp, Homo sapiens; identical to SEQ ID NO: 538999
  misc_feature: HIJSMM301B7382.16.86.H09.1.454.light.4.raw

SEQ ID NO: 578449 - DNA, 513 bp, Homo sapiens; identical to SEQ ID NO: 568964
  misc_feature: HIJSMM301AYMHL.8.23.C01.1.454.light.4.raw

SEQ ID NO: 578450 - DNA, 447 bp, Homo sapiens; identical to SEQ ID NO: 535020
  misc_feature: HIJSMM301ELTKH.18.9.A09.1.454.light.4.raw

SEQ ID NO: 578451 - DNA, 522 bp, Homo sapiens
  misc_feature: HIJSMM301BM9WZ.12.21.B10.1.454.light.4.raw
atacgacgtacacgaccggtgctcgatttagtgtcgtcgcaagagaggagggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaataccccggcaaagtccccaagttaatcatttatgagggcactaagcggcctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctcgttcccaccctt

SEQ ID NO: 578452 - DNA, 487 bp, Homo sapiens
  misc_feature: HIJSMM301B7NC5.52.59.F04.1.454.light.4.raw
cgcagtacgacacgaccggtgctcgatttagtacacacacttagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcacctttcggcggagggaccaaggtggagatcagacgaactgtggctgcaccatctgtctt

SEQ ID NO: 578453 - DNA, 500 bp, Homo sapiens
  misc_feature: HIJSMM301D7DG3.43.57.F02.1.454.light.4.raw
tgtgagtagtcacgaccggtgctcgatttagctcgatatagttgggtttgggggctttgcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgccccctcggtcacgctcgttcccgccctcctcactactcaca

SEQ ID NO: 578454 - DNA, 499 bp, Homo sapiens
  misc_feature: HIJSMM301A2J9G.10.77.G11.1.454.light.4.raw
catagtagtgcacgaccggtgctcgatttagctagtcactcaaggggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgagggaccaaggacggacatacaacgcgaactgtcggcgtgcaccatcctcgtt

SEQ ID NO: 578455 - DNA, 488 bp, Homo sapiens
  misc_feature: HIJSMM301DUCLJ.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccaggtgggtctgggacagagttcactctcaccatcagcagcctgcagtctgaagattttgctactttattactgtcagcaatataatgactggttctcgatcaccttcggccaagggacacgactggagattaaacgaactgtggctgcaccatctgt

SEQ ID NO: 578456 - DNA, 498 bp, Homo sapiens
  misc_feature: HIJSMM301C6AHW.10.68.G02.1.454.light.4.raw
catagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagcccaagctgcccctcggtcactc

SEQ ID NO: 578457 - DNA, 488 bp, Homo sapiens
  misc_feature: HIJSMM301AQL0R.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcaaggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctacggtcagacccg

SEQ ID NO: 578458 - DNA, 505 bp, Homo sapiens; identical to SEQ ID NO: 535503
  misc_feature: HIJSMM301B2EQA.8.28.C06.1.454.light.4.raw

SEQ ID NO: 578459 - DNA, 500 bp, Homo sapiens
  misc_feature: HIJSMM301AERMB.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaacgaactgtggctgcaccatctgtcttctatcttcccg

SEQ ID NO: 578460 - DNA, 353 bp, Homo sapiens; identical to SEQ ID NO: 536338
  misc_feature: HIJSMM301D48NN.3.11.A11.1.454.light.4.raw

SEQ ID NO: 578461 - DNA, 513 bp, Homo sapiens
  misc_feature: HIJSMM301C92FX.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttccgcccta

SEQ ID NO: 578462 - DNA, 444 bp, Homo sapiens; identical to SEQ ID NO: 535594
  misc_feature: HIJSMM301EVLXG.9.9.A09.1.454.light.4.raw

SEQ ID NO: 578463 - DNA, 475 bp, Homo sapiens
  misc_feature: HIJSMM301DKUK3.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtctaagtcagaccccg

SEQ ID NO: 578464 - DNA, 503 bp, Homo sapiens; identical to SEQ ID NO: 536618
  misc_feature: HIJSMM301DF71Q.10.82.H05.1.454.light.4.raw

SEQ ID NO: 578465 - DNA, 487 bp, Homo sapiens; identical to SEQ ID NO: 536536
  misc_feature: HIJSMM301EBQDH.26.45.E01.1.454.light.4.raw

SEQ ID NO: 578466 - DNA, 511 bp, Homo sapiens
  misc_feature: HIJSMM301BH7IW.43.19.B08.1.454.light.4.raw
tgtgagtagtcacgaccggtgctcgatttagtgagtcagtaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgcctcct

SEQ ID NO: 578467 - DNA, 434 bp, Homo sapiens
  misc_feature: HIJSMM301DCLUP.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacaatataatagtcattctcagacgttcggccaagggaccaaggtggaggtcaaacgaactgtggctgcaccatctgtcttcatcttcccgccatctgacatactcgta

SEQ ID NO: 578468 - DNA, 509 bp, Homo sapiens
  misc_feature: HIJSMM301C31K6.18.37.D04.1.454.light.4.raw
  modified_base (498)..(498): a, c, t, g, unknown or other
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagagtcaaacgaaactgtggctgnacccatctgtt

SEQ ID NO: 578469 - DNA, 479 bp, Homo sapiens; identical to SEQ ID NO: 542895
  misc_feature: HIJSMM301CZCT8.40.59.F04.1.454.light.4.raw

SEQ ID NO: 578470 - DNA, 472 bp, Homo sapiens
  misc_feature: HIJSMM301BDCAF.49.73.G07.1.454.light.4.raw
agtcgagagacacgaccggtgctcgatttagctctacgctcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaactgtggctgcaccta

SEQ ID NO: 578471 - DNA, 489 bp, Homo sapiens; identical to SEQ ID NO: 535139
  misc_feature: HIJSMM301D6JE1.14.55.E11.1.454.light.4.raw

SEQ ID NO: 578472 - DNA, 488 bp, Homo sapiens
  misc_feature: HIJSMM301A7FCH.48.55.E11.1.454.light.4.raw
agtatacatacacgaccggtgctcgatttagcactcgcacgttgggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggccaagggaccaaggtggaagtactaaacgaaactcgtggctgcaccta

SEQ ID NO: 578473 - DNA, 483 bp, Homo sapiens
  misc_feature: HIJSMM301B1G1C.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatcttatgtcttcggatctgggaccagggtcaccgtctaggtcagcccaaggccaa

SEQ ID NO: 578474 - DNA, 506 bp, Homo sapiens; identical to SEQ ID NO: 536038
  misc_feature: HIJSMM301AHTJD.7.71.G05.1.454.light.4.raw

SEQ ID NO: 578475 - DNA, 465 bp, Homo sapiens
  misc_feature: HIJSMM301BJJ56.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagtactttactctcaccatcagcagcctgcagcctgaagatattgcaacatattactgtcaacagtatgatcgtctcctcaatttcggccctgggaccagagtggacatgaaacgaa

SEQ ID NO: 578476 - DNA, 512 bp, Homo sapiens; identical to SEQ ID NO: 541402
  misc_feature: HIJSMM301BWZ90.43.19.B08.1.454.light.4.raw

SEQ ID NO: 578477 - DNA, 512 bp, Homo sapiens
  misc_feature: HIJSMM301ATIX4.52.67.G01.1.454.light.4.raw
cgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactggcctccgacgttcggccaagggaccaaggtggaaatcaaacgaactagtggctgcaccatctgtcttcta

SEQ ID NO: 578478 - DNA, 519 bp, Homo sapiens
  misc_feature: HIJSMM301DF26N.12.71.G05.1.454.light.4.raw
  modified_base (509)..(509): a, c, t, g, unknown or other
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgcccctcggtcactctnttcccgccct

SEQ ID NO: 578479 - DNA, 504 bp, Homo sapiens
  misc_feature: HIJSMM301C099K.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaaacgaactagtggctgcaccatctgtcttcattcc

SEQ ID NO: 578480 - DNA, 511 bp, Homo sapiens
  misc_feature: HIJSMM301AHKT2.48.51.E07.1.454.light.4.raw
agtatacatacacgaccggtgctcgatttagcatactctacaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctgccccctcggtcactc

SEQ ID NO: 578481 - DNA, 524 bp, Homo sapiens; identical to SEQ ID NO: 539528
  misc_feature: HIJSMM301AOJZQ.49.9.A09.1.454.light.4.raw

SEQ ID NO: 578482 - DNA, 487 bp, Homo sapiens; identical to SEQ ID NO: 536025
  misc_feature: HIJSMM301B0N49.17.34.D01.1.454.light.4.raw

SEQ ID NO: 578483 - DNA, 496 bp, Homo sapiens
  misc_feature: HIJSMM301EUS6T.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccaggtggaaagtcaaacgaactagtggctgcaccatctgtcttcatt

SEQ ID NO: 578484 - DNA, 502 bp, Homo sapiens
  misc_feature: HIJSMM301AIH4J.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtggaaatacaaacgaactagtggctgcacca

SEQ ID NO: 578485 - DNA, 498 bp, Homo sapiens
  misc_feature: HIJSMM301DCZ39.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtccactctcgttcccgt

SEQ ID NO: 578486 - DNA, 505 bp, Homo sapiens
  misc_feature: HIJSMM301CNUVD.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtcact

SEQ ID NO: 578487 - DNA, 485 bp, Homo sapiens
  misc_feature: HIJSMM301E0G2J.52.5.A05.1.454.light.4.raw
cgcagtacgacacgaccggtgctcgatttagatagatagacagggggggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgtcttttcggcggagggaccaagctgaccgtcctacgtcagcccaaggctgccccctcggtca

SEQ ID NO: 578488 - DNA, 496 bp, Homo sapiens
  misc_feature: HIJSMM301DBUYX.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccagggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcaggtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 578489 - DNA, 476 bp, Homo sapiens
  misc_feature: HIJSMM301EN8O8.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaaacttactactgtcagcagtcttacagtaggccgggcacctttggccaggggacgaaagctggagatcgaaacgaactgtggctgcaccatctgtcttcatcttcccgccatctgagacacgcgag

SEQ ID NO: 578490 - DNA, 483 bp, Homo sapiens; identical to SEQ ID NO: 545413
  misc_feature: HIJSMM301BD18A.16.81.H04.1.454.light.4.raw

SEQ ID NO: 578491 - DNA, 444 bp, Homo sapiens; identical to SEQ ID NO: 534993
  misc_feature: HIJSMM301BBP49.5.9.A09.1.454.light.4.raw

SEQ ID NO: 578492 - DNA, 460 bp, Homo sapiens; identical to SEQ ID NO: 545790
  misc_feature: HIJSMM301DBZ1T.22.28.C06.1.454.light.4.raw
  modified_base (442)..(442): a, c, t, g, unknown or other

SEQ ID NO: 578493 - DNA, 500 bp, Homo sapiens
  misc_feature: HIJSMM301C8ZKW.40.43.D10.1.454.light.4.raw
tctagcgactcacgaccggtgctcgatttagactagcagtagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcggccaagggaccaaggtggacatcaagcgaactgtggctgcaccatctgtcttcatcttcccgccact

SEQ ID NO: 578494 - DNA, 473 bp, Homo sapiens; identical to SEQ ID NO: 535262
  misc_feature: HIJSMM301CZE43.8.67.G01.1.454.light.4.raw

SEQ ID NO: 578495 - DNA, 491 bp, Homo sapiens
  misc_feature: HIJSMM301A1LQ6.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcacc

SEQ ID NO: 578496 - DNA, 486 bp, Homo sapiens; identical to SEQ ID NO: 535043
  misc_feature: HIJSMM301BLLM4.46.35.D02.1.454.light.4.raw

SEQ ID NO: 578497 - DNA, 494 bp, Homo sapiens; identical to SEQ ID NO: 542264
  misc_feature: HIJSMM301EAE17.13.6.A06.1.454.light.4.raw

SEQ ID NO: 578498 - DNA, 508 bp, Homo sapiens; identical to SEQ ID NO: 538497
  misc_feature: HIJSMM301CWE7X.11.57.F02.1.454.light.4.raw

SEQ ID NO: 578499 - DNA, 494 bp, Homo sapiens; identical to SEQ ID NO: 534994
  misc_feature: HIJSMM301ESVUB.27.78.H01.1.454.light.4.raw

SEQ ID NO: 578500 - DNA, 507 bp, Homo sapiens; identical to SEQ ID NO: 538063
  misc_feature: HIJSMM301DOH52.47.85.H08.1.454.light.4.raw

SEQ ID NO: 578501 - DNA, 480 bp, Homo sapiens
  misc_feature: HIJSMM301CL0L9.11.11.A11.1.454.light.4.raw
cgagagataccacgaccggtgctcgatttagctacgactgcaggggcagcaagatggtgttgcagacccaggtcttcatttctctattgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaaacctgcaggctgaagatgtggcagtttattactgtcagcagtattgtgaagctccgctcactttcggcggacgggaccgcggtggagatcagacgaactgtggctgcaccatctgtctt

SEQ ID NO: 578502 - DNA, 511 bp, Homo sapiens
  misc_feature: HIJSMM301DKHFT.5.59.F04.1.454.light.4.raw
atcagacacgcacgaccggtgctcgatttagtacacacacttagggattgggggagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcgaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccgacgggaccgaacggtaggaaatacaaacgaactagtggcgtgcaccatctgtcttctatcttcccgccta

SEQ ID NO: 578503 - DNA, 484 bp, Homo sapiens
  misc_feature: HIJSMM301CQY4M.3.46.E02.1.454.light.4.raw
agacgcactccacgaccggtgctcgatttagactcatctacagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccaacagaaacctggccaggctcccaggctcctcattcatggtgcatctaacagggccgatggcattccagccaggttcagtggcagtggatatgggacagacttcactctcaccatcagcaatctgcagtctgaagattttgcagtttatttctgtcagcagtttacacctggcctggaagttttggccaggggaccaagctggagctcaaacgaactgtggctgcaccat

SEQ ID NO: 578504 - DNA, 500 bp, Homo sapiens
  misc_feature: HIJSMM301A5XRR.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaacccca

SEQ ID NO: 578505 - DNA, 495 bp, Homo sapiens
  misc_feature: HIJSMM301C1YAY.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgacaactttattactcgccaacactatgattacgttacccgctctactttcggcgggtagggaccgaagggtggaggtcaagcgaactggtggctgcaccta

SEQ ID NO: 578506 - DNA, 479 bp, Homo sapiens
  misc_feature: HIJSMM301AZ5T3.51.11.A11.1.454.light.4.raw
cgatcgtatacacgaccggtgctcgatttagctacgactgcagggggtgggggcacttctccctctaacactctccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggaggatcaaacgaaactgtggctgcaccatctgtcttcatt

SEQ ID NO: 578507 - DNA, 509 bp, Homo sapiens; identical to SEQ ID NO: 539359
  misc_feature: HIJSMM301EVD4E.47.85.H08.1.454.light.4.raw

SEQ ID NO: 578508 - DNA, 492 bp, Homo sapiens
  misc_feature: HIJSMM301DUPG9.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactggacgaacgtcaccgcctacgtcagccaacgg

SEQ ID NO: 578509 - DNA, 492 bp, Homo sapiens
  misc_feature: HIJSMM301CDKLT.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgttcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgg

SEQ ID NO: 578510 - DNA, 492 bp, Homo sapiens
  misc_feature: HIJSMM301B6ZJK.48.51.E07.1.454.light.4.raw
agtatacatacacgaccggtgctcgatttagcatactctacaacacacaaagggggaagacaatgggtttgatttagattacatgggtgacttttctgttttatttccaatctcagataccaccggagaaattgtgttgacgcagtctttaggcaccctgtctttgtctccagggaaaagagccaccctctcctgcagggccagtcagactgttagcagcagctactgagcctggtaccagctgaaacctggccaggctcccctgctcctcatctatggtgcatccagcagggccactggcatcccagacaggttcagtggcagtgggtctgggacagacttcactctcaccatcttcagactggagcctgaagattttgcagtgtattactgtcagcagtatggtaactcaacggaggacttttggccaggggaccaagctggagatcaaacgaactgtggctgcaccatctgtcttcatcttcccgccat

SEQ ID NO: 578511 - DNA, 504 bp, Homo sapiens
  misc_feature: HIJSMM301CI0CD.48.37.D04.1.454.light.4.raw
agtatacatacacgaccggtgctcgatttagtagcatactgttgggtttgggggaggaactgctcagttaggacccagacggaaccatggaagccccagcgcagcttctcttcctcctgctactctggctcccagattccactggacaaatagtgatgacgtagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgactgtggctgcaccatctgtcttcatcttcccgcc

SEQ ID NO: 578512 - DNA, 521 bp, Homo sapiens; identical to SEQ ID NO: 539470
  misc_feature: HIJSMM301E3X0O.27.23.C01.1.454.light.4.raw

SEQ ID NO: 578513 - DNA, 479 bp, Homo sapiens; identical to SEQ ID NO: 570983
  misc_feature: HIJSMM301ATNE7.11.76.G10.1.454.light.4.raw

SEQ ID NO: 578514 - DNA, 484 bp, Homo sapiens; identical to SEQ ID NO: 550726
  misc_feature: HIJSMM301BT0QJ.47.62.F07.1.454.light.4.raw

SEQ ID NO: 578515 - DNA, 514 bp, Homo sapiens
  misc_feature: HIJSMM301ESE4K.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtggggcaggtcagccaaggctgcccctcggtcactctgtcccgccctcctccacg

SEQ ID NO: 578516 - DNA, 494 bp, Homo sapiens
  misc_feature: HIJSMM301EDOLI.43.38.D05.1.454.light.4.raw
tgtgagtagtcacgaccggtgctcgatttagtatctgatagttgggtttggggcagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcac

SEQ ID NO: 578517 - DNA, 483 bp, Homo sapiens; identical to SEQ ID NO: 542674
  misc_feature: HIJSMM301EZYWD.21.25.C03.1.454.light.4.raw

SEQ ID NO: 578518 - DNA, 516 bp, Homo sapiens
  misc_feature: HIJSMM301AFW5K.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctggggacagacttcactctcaccatcatcagcctggagcctgaagatgttgcagtttattactgtcaacatcgtaccgagtggcctccgggggccactttcggtccctcgggaccgaaagtaggagtatcaaacgaaactgtggcgtgcaccactctcgtcttt

SEQ ID NO: 578519 - DNA, 494 bp, Homo sapiens; identical to SEQ ID NO: 539784
  misc_feature: HIJSMM301CWRF8.22.57.F02.1.454.light.4.raw

SEQ ID NO: 578520 - DNA, 508 bp, Homo sapiens
  misc_feature: HIJSMM301D4XN9.5.24.C02.1.454.light.4.raw
  modified_base (451)..(451): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtnatcttcggcggggggaccaaggctgaccgtcctaggtcagcccaaggctgccccccg

SEQ ID NO: 578521 - DNA, 497 bp, Homo sapiens
  misc_feature: HIJSMM301DIVP1.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctataggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctagtcagcccaaggctgccccctcggtcactctcg

SEQ ID NO: 578522 - DNA, 516 bp, Homo sapiens
  misc_feature: HIJSMM301DJEK7.17.28.C06.1.454.light.4.raw
cgtagactagcacgaccggtgctcgatttagagctcacgtattgggtttggggagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaaagtcagcccaaggctgcccccctggtccactctgttcccaccct

SEQ ID NO: 578523 - DNA, 494 bp, Homo sapiens
  misc_feature: HIJSMM301ELFLK.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgacggtcggagtgtctaagcgaacgtgtggctgcaccatctcg

SEQ ID NO: 578524 - DNA, 487 bp, Homo sapiens; identical to SEQ ID NO: 553491
  misc_feature: HIJSMM301DISQX.4.27.C05.1.454.light.4.raw

SEQ ID NO: 578525 - DNA, 498 bp, Homo sapiens; identical to SEQ ID NO: 540742
  misc_feature: HIJSMM301DO47R.18.59.F04.1.454.light.4.raw

SEQ ID NO: 578526 - DNA, 473 bp, Homo sapiens; identical to SEQ ID NO: 535262
  misc_feature: HIJSMM301B9OPS.8.67.G01.1.454.light.4.raw

SEQ ID NO: 578527 - DNA, 486 bp, Homo sapiens; identical to SEQ ID NO: 535043
  misc_feature: HIJSMM301B0KBH.46.35.D02.1.454.light.4.raw

SEQ ID NO: 578528 - DNA, 498 bp, Homo sapiens; identical to SEQ ID NO: 545227
  misc_feature: HIJSMM301D2H4J.5.20.B09.1.454.light.4.raw

SEQ ID NO: 578529 - DNA, 511 bp, Homo sapiens
  misc_feature: HIJSMM301D9GWD.22.65.F10.1.454.light.4.raw
  modified_base (479)..(479): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgactcacccttcggtccgaacggaacgacgacgtggaggaattaaacgtaaacgngtggtcgtcgtcaccaactcttgtcttctact

SEQ ID NO: 578530 - DNA, 500 bp, Homo sapiens
  misc_feature: HIJSMM301DVRTL.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttggtgttcggcggaggaccaaactgaccgtctaggtcagccccaa

SEQ ID NO: 578531 - DNA, 527 bp, Homo sapiens
  misc_feature: HIJSMM301A81R8.16.59.F04.1.454.light.4.raw
tgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctcgaccctttcgggtgcgcagcctgaggatgaggctgagtattactgcttgctctcctatagtggtgttcgggtgttcggcggagggaccaagctgaccgtcctaggtcagcccaaggctcgccccctcggtcattctgttcccgccctcctcgagtagtaca

SEQ ID NO: 578532 - DNA, 503 bp, Homo sapiens; identical to SEQ ID NO: 535140
  misc_feature: HIJSMM301AQ6CK.18.37.D04.1.454.light.4.raw

SEQ ID NO: 578533 - DNA, 497 bp, Homo sapiens
  misc_feature: HIJSMM301EBCOA.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcagggtccctgatcgcttctctgcctccaagtctggcaacacggcctccctgaccgtctctgggctccagcctgaggatgaggctgattattaactgcagctcatatgcaggcatcaacactgttttcggcggaggaccaagctgaccgtcctaggtcagcccaaggctgtccccccg

SEQ ID NO: 578534 - DNA, 486 bp, Homo sapiens; identical to SEQ ID NO: 537127
  misc_feature: HIJSMM301DNUBK.3.77.G11.1.454.light.4.raw

SEQ ID NO: 578535 - DNA, 477 bp, Homo sapiens
  misc_feature: HIJSMM301B9AGH.52.22.B11.1.454.light.4.raw
cgcagtacgacacgaccggtgctcgatttagacgacagctcaggggcagtctcagtcaggacacagcatggacatgagggtccccgctcagctcctggggctcctgctactctggctcctaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtccatcaaggttcagtggcagtggatctgggacagaattcactctcaccatcaccagtctgcaggctgaggattttgcaacttacttctgtcaacagagttacagttccctcactttcggccctcgggaccatagtggatatcaaacgaactgtggctgcaccatctgtctt

SEQ ID NO: 578536 - DNA, 485 bp, Homo sapiens; identical to SEQ ID NO: 536075
  misc_feature: HIJSMM301DTOLP.17.21.B10.1.454.light.4.raw

SEQ ID NO: 578537 - DNA, 508 bp, Homo sapiens
  misc_feature: HIJSMM301AZSP6.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaaacgaactagtggctgcaccatctgtcttcta

SEQ ID NO: 578538 - DNA, 497 bp, Homo sapiens
  misc_feature: HIJSMM301BLWVR.22.14.B03.1.454.light.4.raw
  modified_base (445)..(445): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctnagacgttcggccaagggaccaaggtggaaatcaaacgaactgtggctgcacc

SEQ ID NO: 578539 - DNA, 520 bp, Homo sapiens; identical to SEQ ID NO: 539176
  misc_feature: HIJSMM301B2SHM.27.23.C01.1.454.light.4.raw

SEQ ID NO: 578540 - DNA, 494 bp, Homo sapiens; identical to SEQ ID NO: 534994
  misc_feature: HIJSMM301CBVHZ.27.78.H01.1.454.light.4.raw

SEQ ID NO: 578541 - DNA, 503 bp, Homo sapiens
  misc_feature: HIJSMM301A92J5.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 578542 - DNA, 501 bp, Homo sapiens; identical to SEQ ID NO: 568432
  misc_feature: HIJSMM301D0HQU.2.49.E05.1.454.light.4.raw

SEQ ID NO: 578543 - DNA, 517 bp, Homo sapiens
  misc_feature: HIJSMM301D5GTJ.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctggtcactctgttcccaccctcctccacg

SEQ ID NO: 578544 - DNA, 496 bp, Homo sapiens; identical to SEQ ID NO: 573663
  misc_feature: HIJSMM301DF2WE.10.33.C11.1.454.light.4.raw

SEQ ID NO: 578545 - DNA, 486 bp, Homo sapiens; identical to SEQ ID NO: 535458
  misc_feature: HIJSMM301EYLP4.7.75.G09.1.454.light.4.raw

SEQ ID NO: 578546 - DNA, 488 bp, Homo sapiens; identical to SEQ ID NO: 536861
  misc_feature: HIJSMM301D2XO1.12.88.H11.1.454.light.4.raw

SEQ ID NO: 578547 - DNA, 513 bp, Homo sapiens; identical to SEQ ID NO: 559106
  misc_feature: HIJSMM301A74B0.11.57.F02.1.454.light.4.raw

SEQ ID NO: 578548 - DNA, 490 bp, Homo sapiens; identical to SEQ ID NO: 549445
  misc_feature: HIJSMM301DTM7F.52.85.H08.1.454.light.4.raw

SEQ ID NO: 578549 - DNA, 488 bp, Homo sapiens; identical to SEQ ID NO: 535990
  misc_feature: HIJSMM301BHUPH.11.28.C06.1.454.light.4.raw

SEQ ID NO: 578550 - DNA, 501 bp, Homo sapiens
  misc_feature: HIJSMM301CO078.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggaggaccaagctgaccgtcctaggtcagcccaaggctgccccctcggtcactctgttcccgccctcctcgctacgtaga

SEQ ID NO: 578551 - DNA, 446 bp, Homo sapiens; identical to SEQ ID NO: 536034
  misc_feature: HIJSMM301C636F.18.9.A09.1.454.light.4.raw

SEQ ID NO: 578552 - DNA, 482 bp, Homo sapiens
  misc_feature: HIJSMM301APZSV.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcag

SEQ ID NO: 578553 - DNA, 448 bp, Homo sapiens
  misc_feature: HIJSMM301ATI0Z.11.86.H09.1.454.light.4.raw
cgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccgccctcctcgtatctctcg

SEQ ID NO: 578554 - DNA, 497 bp, Homo sapiens; identical to SEQ ID NO: 536371
  misc_feature: HIJSMM301BZGI0.16.78.H01.1.454.light.4.raw

SEQ ID NO: 578555 - DNA, 504 bp, Homo sapiens
  misc_feature: HIJSMM301DEQES.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtctaggtcagcccaaggctgccccctcggtcactctgttcccgccctcctcg

SEQ ID NO: 578556 - DNA, 478 bp, Homo sapiens
  misc_feature: HIJSMM301DMW2S.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtgcccgctcattttcggcggagggaccaaggtgcagatcaaacgaactgtgg

SEQ ID NO: 578557 - DNA, 506 bp, Homo sapiens
  misc_feature: HIJSMM301A9N04.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagctggccgttcacgtttcggcggagggaccaaggtggacctacaaacgaactgtggctgcaccatctgtcttcatccttcccgc

SEQ ID NO: 578558 - DNA, 518 bp, Homo sapiens
  misc_feature: HIJSMM301A4QK8.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacacagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 578559 - DNA, 490 bp, Homo sapiens
  misc_feature: HIJSMM301CU7MH.4.64.F09.1.454.light.4.raw
agcactgtagcacgaccggtgctcgatttagcgcgtatacaagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccaggggaccaaggtggagatcaaacgaactgtggcctgcaccatcctgtcttcatt

SEQ ID NO: 578560 - DNA, 514 bp, Homo sapiens
  misc_feature: HIJSMM301D9IXB.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgctagtttattactgtcaacatcgtaccgagtcggccgtccgggggccacgtttcggcccgtgggaccgaaggtggagatcaaacgaactgtggctgcaccatctgtcttcta

SEQ ID NO: 578561 - DNA, 507 bp, Homo sapiens
  misc_feature: HIJSMM301BN8TU.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccgattctctggttccttgtctgacacctcagcctccctggccatcactgggctccagcctgaggatgaggctgattattactgtcagtcctttgactattaaactggatgtggtattcggcggagggacccacgtaaccgtcctaggtcagcccaaggctgccccctcggtcactctgttcccgccct

SEQ ID NO: 578562 - DNA, 382 bp, Homo sapiens; identical to SEQ ID NO: 575433
  misc_feature: HIJSMM301BBSMJ.41.26.C04.1.454.light.4.raw

SEQ ID NO: 578563 - DNA, 492 bp, Homo sapiens
  misc_feature: HIJSMM301BD3NH.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaactattactgtcaacagtttaataactaccctctcactttcggaggagggaccagggtggaggatcaaagaactgtggctgcaccatctgtcttcta

SEQ ID NO: 578564 - DNA, 492 bp, Homo sapiens
  misc_feature: HIJSMM301BKDK0.52.31.C09.1.454.light.4.raw
cgcagtacgacacgaccggtgctcgatttagacgtctcatcaaggaaggaagggggctgtgggctcaggaggcagagctctgggaatctcaccatggcctggacccctctcctgctccccctcctcactttctgcacagtctctgaggcctcctatgagctgacacagccaccctcggtgtcagtgtccccagcacaaacggccaggatcacctgctctggagatgcattgccaaaaaaatatgcttattggtaccagcagaggtcaggccaggcccctatattgatcatctatgaagacagcaaacgacccgctgggatccctcagagattctctggctccagctcagggacaatggccaccttgactatcactggggcccaggtggaggatgaagctgccttctattgtttttcaacagacagcagtggtaatcatagggtgttcggcggagggaccaggctgaccgtcctaggtcagcccaaggctccg

SEQ ID NO: 578565 - DNA, 509 bp, Homo sapiens
  misc_feature: HIJSMM301DOSQ0.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccgactttcggcccgtgggaccaaagtggatatcaaacgaactagtggctgcaccatctgtctt

SEQ ID NO: 578566 - DNA, 504 bp, Homo sapiens; identical to SEQ ID NO: 535561
  misc_feature: HIJSMM301B1CXV.4.57.F02.1.454.light.4.raw

SEQ ID NO: 578567 - DNA, 516 bp, Homo sapiens
  misc_feature: HIJSMM301DVARC.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagttggccgtgggtctgggacagagttcagtctcaccatcagcagactggagcctgaagattttgcagtatattactgtcagcaatatggtacttcaccccggacgtcgtccaaggaccaacggtcggaagtactaaacgaactagtaggcgtgcgaccatctgtcgttctatcttcccgtcccact

SEQ ID NO: 578568 - DNA, 481 bp, Homo sapiens
  misc_feature: HIJSMM301B5YBE.11.11.A11.1.454.light.4.raw
  modified_base (463)..(463): a, c, t, g, unknown or other
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagttttattactgtcagcagttattgtgaagctccgctcactttcggcggagggaccgcgggtggagatcagacgaactgnggctgcaccatctgtctt

SEQ ID NO: 578569 - DNA, 516 bp, Homo sapiens; identical to SEQ ID NO: 553885
  misc_feature: HIJSMM301A7CAK.22.36.D03.1.454.light.4.raw

SEQ ID NO: 578570 - DNA, 490 bp, Homo sapiens; identical to SEQ ID NO: 572219
  misc_feature: HIJSMM301A3QAP.3.10.A10.1.454.light.4.raw

SEQ ID NO: 578571 - DNA, 509 bp, Homo sapiens; identical to SEQ ID NO: 539359
  misc_feature: HIJSMM301BUP9A.47.85.H08.1.454.light.4.raw

SEQ ID NO: 578572 - DNA, 498 bp, Homo sapiens; identical to SEQ ID NO: 538749
  misc_feature: HIJSMM301D11C4.43.34.D01.1.454.light.4.raw

SEQ ID NO: 578573 - DNA, 483 bp, Homo sapiens
  misc_feature: HIJSMM301ENPRP.4.41.D08.1.454.light.4.raw
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttgccaggggaccaaggtagagatcaaacgaactgtggctgcaccat

SEQ ID NO: 578574 - DNA, 486 bp, Homo sapiens
  misc_feature: HIJSMM301CIN67.17.57.F02.1.454.light.4.raw
cgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaactttttaaattggtatcagcgggaaccagggaaagcccctaaactcctgatctatactgcatccaatttgcaaagtgggtcccatcaaggttcagtggcagtggatctgggacagatttcactctcaccatcagcagtctgcaacctgaggattttgcaacttactactgtcaacagggttacagtaccccgtacacttttggccaggggaccaagctggagatcaaacgactgtggctgcaccat

SEQ ID NO: 578575 - DNA, 473 bp, Homo sapiens; identical to SEQ ID NO: 538875
  misc_feature: HIJSMM301DEOSA.4.75.G09.1.454.light.4.raw

SEQ ID NO: 578576 - DNA, 485 bp, Homo sapiens; identical to SEQ ID NO: 535985
  misc_feature: HIJSMM301EN8AZ.15.1.A01.1.454.light.4.raw

SEQ ID NO: 578577 - DNA, 505 bp, Homo sapiens; identical to SEQ ID NO: 568386
  misc_feature: HIJSMM301B4WJY.52.34.D01.1.454.light.4.raw

SEQ ID NO: 578578 - DNA, 492 bp, Homo sapiens
  misc_feature: HIJSMM301BA225.51.25.C03.1.454.light.4.raw
cgatcgtatacacgaccggtgctcgatttagtagtgtagatttgggtttggggtgggggcacttctccctctaacactctccccgctcagctcctggggctcctgctactctggctccgaggtgccagatgtgacatccagatgacccagtctccatcctccctgtctgcatctataggagacagagtcacaatcccttgccggtcaagtcaaaacattagcaactatttaaattggtatcaacagaaaccagggaaagcccctaacctcctgatctatgctgcttccactttgcaaagtggggtcccatcgaggttcagtggcagtggatctgggacagatttcagtctcaccatcaccaatctgcgacctgaagattttgcaacttattattgtcaacaggcttacatcacccctctcactttcggcggagggaccaaggtggagatcaaacgaactgtggctgcaccatctgtcttcatcttccgccat

SEQ ID NO: 578579 - DNA, 532 bp, Homo sapiens
  misc_feature: HIJSMM301E3SR3.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggcgtgaggagtgttggtcgatttatttaacttgcatgcgaggcgtactaacctaacccttcccttcgtcctaccttttcggttccggacggggaacccgggaaacgaccgtaggtcggagtacacgggacgaacc

SEQ ID NO: 578580 - DNA, 447 bp, Homo sapiens; identical to SEQ ID NO: 535201
  misc_feature: HIJSMM301EDIX9.18.9.A09.1.454.light.4.raw

SEQ ID NO: 578581 - DNA, 481 bp, Homo sapiens; identical to SEQ ID NO: 538112
  misc_feature: HIJSMM301DFUW1.19.71.G05.1.454.light.4.raw

SEQ ID NO: 578582 - DNA, 474 bp, Homo sapiens; identical to SEQ ID NO: 548453
  misc_feature: HIJSMM301BG0PE.3.1.A01.1.454.light.4.raw

SEQ ID NO: 578583 - DNA, 492 bp, Homo sapiens; identical to SEQ ID NO: 544389
  misc_feature: HIJSMM301BZO7T.22.25.C03.1.454.light.4.raw

SEQ ID NO: 578584 - DNA, 514 bp, Homo sapiens; identical to SEQ ID NO: 545978
  misc_feature: HIJSMM301AVQO2.17.33.C11.1.454.light.4.raw

SEQ ID NO: 578585 - DNA, 511 bp, Homo sapiens; identical to SEQ ID NO: 537464
  misc_feature: HIJSMM301D5S4R.7.34.D01.1.454.light.4.raw

SEQ ID NO: 578586 - DNA, 459 bp, Homo sapiens
  misc_feature: HIJSMM301E312W.51.34.D01.1.454.light.4.raw
  modified_base (430)..(430): a, c, t, g, unknown or other
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaattataacaggcgtngctcacttcgtcggggcggacggaggaga

SEQ ID NO: 578587 - DNA, 492 bp, Homo sapiens; identical to SEQ ID NO: 534967
  misc_feature: HIJSMM301DU0K9.47.64.F09.1.454.light.4.raw

SEQ ID NO: 578588 - DNA, 455 bp, Homo sapiens; identical to SEQ ID NO: 535447
  misc_feature: HIJSMM301DPI0G.19.71.G05.1.454.light.4.raw

SEQ ID NO: 578589 - DNA, 454 bp, Homo sapiens; identical to SEQ ID NO: 534964
  misc_feature: HIJSMM301DID8Y.19.86.H09.1.454.light.4.raw

SEQ ID NO: 578590 - DNA, 486 bp, Homo sapiens; identical to SEQ ID NO: 535043
  misc_feature: HIJSMM301AZCBT.46.35.D02.1.454.light.4.raw

SEQ ID NO: 578591 - DNA, 484 bp, Homo sapiens; identical to SEQ ID NO: 466217
  misc_feature: HIJSMM301DO3CS.15.1.A01.1.454.light.4.raw

SEQ ID NO: 578592 - DNA, 521 bp, Homo sapiens; identical to SEQ ID NO: 539470
  misc_feature: HIJSMM301BA4UF.27.23.C01.1.454.light.4.raw

SEQ ID NO: 578593 - DNA, 513 bp, Homo sapiens; identical to SEQ ID NO: 541387
  misc_feature: HIJSMM301ENZ55.17.33.C11.1.454.light.4.raw

SEQ ID NO: 578594 - DNA, 486 bp, Homo sapiens
  misc_feature: HIJSMM301EHEMP.41.12.B01.1.454.light.4.raw
tctatactatcacgaccggtgctcgatttagtagtgtagattccgcggggagacccagtcaggacacagcatggacatgagagtcctcgctcagctcctggggctcctgctgctctgtttcccaggtgccagatgtgacatccagatgacccagtctccgtcctcactgtctgcatctgtgggagacagagtcaccatcacttgtcgggcgagtcaggacattagcaattatttagcctggtttcagcagaaacccggcaacgcccctaaatccctaatctatgctgcatccactttgcgaagtggggtcccgtcaaagttcagcggcggcagatctgggacagacttcactctcaccatcagcaacctgcagcctgaagattttgctacttattactgccaacaatacagcacgtttcccctcactttcggcggagggaccagggtggagatcaaacgaactgtggctgcaccatctgtcttcta

SEQ ID NO: 578595 - DNA, 508 bp, Homo sapiens
  misc_feature: HIJSMM301D7MU4.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggagaggctgactattactgcctactctactttggtggtgctgtgctattcggcggagggaccaagctgaccgtcttaagtcagcccaaggctgccccctcggtcactctgttcccg

SEQ ID NO: 578596 - DNA, 483 bp, Homo sapiens
  misc_feature: HIJSMM301BXYE5.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcaccatt

SEQ ID NO: 578597 - DNA, 489 bp, Homo sapiens; identical to SEQ ID NO: 535139
  misc_feature: HIJSMM301ARLF7.14.55.E11.1.454.light.4.raw

SEQ ID NO: 578598 - DNA, 518 bp, Homo sapiens; identical to SEQ ID NO: 539372
  misc_feature: HIJSMM301AVUHV.7.86.H09.1.454.light.4.raw

SEQ ID NO: 578599 - DNA, 487 bp, Homo sapiens
  misc_feature: HIJSMM301D8XOM.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacatatgatatttattctccagcgttcggccagggaccaaggtggaagtcaagcgaactgtggctgcaccatctgtt

SEQ ID NO: 578600 - DNA, 517 bp, Homo sapiens
  misc_feature: HIJSMM301EBFHP.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttccctcgttgggtgttcggcggagggaccatgctgaccgtcctgagtcagcccaaggctgccccctcggtcactctcgttcccaccct

SEQ ID NO: 578601 - DNA, 487 bp, Homo sapiens
  misc_feature: HIJSMM301DDAUB.12.31.C09.1.454.light.4.raw
  modified_base (365)..(365): a, c, t, g, unknown or other
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtggttcccgtcaaggttcactggccgtggatcagggacagaatttacnctcaccatcagtagtctacagcctgaagatattgctacttattactgtcagcagagttaccgcgctcccatcactttcggccaagggacacgaccgcagattggacgaactgtggctgcacc

SEQ ID NO: 578602 - DNA, 502 bp, Homo sapiens; identical to SEQ ID NO: 541971
  misc_feature: HIJSMM301B19YD.4.39.D06.1.454.light.4.raw

SEQ ID NO: 578603 - DNA, 484 bp, Homo sapiens
  misc_feature: HIJSMM301BFERC.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctcgacgttcggccaagggacaaggtggaactcaacgaa

SEQ ID NO: 578604 - DNA, 444 bp, Homo sapiens; identical to SEQ ID NO: 536484
  misc_feature: HIJSMM301DS3A2.8.11.A11.1.454.light.4.raw

SEQ ID NO: 578605 - DNA, 460 bp, Homo sapiens; identical to SEQ ID NO: 537107
  misc_feature: HIJSMM301AF2ZS.22.28.C06.1.454.light.4.raw

SEQ ID NO: 578606 - DNA, 480 bp, Homo sapiens; identical to SEQ ID NO: 556526
  misc_feature: HIJSMM301DZ0WF.11.76.G10.1.454.light.4.raw

SEQ ID NO: 578607 - DNA, 477 bp, Homo sapiens; identical to SEQ ID NO: 543681
  misc_feature: HIJSMM301D7TTQ.3.82.H05.1.454.light.4.raw

SEQ ID NO: 578608 - DNA, 509 bp, Homo sapiens; identical to SEQ ID NO: 541829
  misc_feature: HIJSMM301DKRS3.17.28.C06.1.454.light.4.raw

SEQ ID NO: 578609 - DNA, 499 bp, Homo sapiens
  misc_feature: HIJSMM301CBLSW.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggcctctcgatgaggctgactattactgccaggcgtgggacagctccacttcccgttatgtcttcggaggtgggaccatggtcaccgtcctaggtcagcccaagacccaaccccactgt

SEQ ID NO: 578610 - DNA, 352 bp, Homo sapiens; identical to SEQ ID NO: 535995
  misc_feature: HIJSMM301ED0XN.4.67.G01.1.454.light.4.raw

SEQ ID NO: 578611 - DNA, 514 bp, Homo sapiens; identical to SEQ ID NO: 571577
  misc_feature: HIJSMM301BO5A0.16.83.H06.1.454.light.4.raw

SEQ ID NO: 578612 - DNA, 502 bp, Homo sapiens
  misc_feature: HIJSMM301CQ3CA.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccgaagctgaccgtcctaggtcagcccaaggctgccccctcggtcta

SEQ ID NO: 578613 - DNA, 520 bp, Homo sapiens
  misc_feature: HIJSMM301APCG2.9.12.B01.1.454.light.4.raw
tgatacgtctcacgaccggtgctcgatttagtagtgtagattccgcgggggacgaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaacgggaccgaaggtggaaagtacaaacgaactaggtaggcgtgcgaccatctcgtcttctactcctttccccg

SEQ ID NO: 578614 - DNA, 491 bp, Homo sapiens; identical to SEQ ID NO: 573437
  misc_feature: HIJSMM301AMRTH.22.65.F10.1.454.light.4.raw

SEQ ID NO: 578615 - DNA, 482 bp, Homo sapiens
  misc_feature: HIJSMM301BGWUJ.48.53.E09.1.454.light.4.raw
agtatacatacacgaccggtgctcgatttagagagagtgtgttgggtttggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatacaacgaactgtgg

SEQ ID NO: 578616 - DNA, 495 bp, Homo sapiens
  misc_feature: HIJSMM301CT4EF.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttatttactgtcagcagcgtacaactggccgctcacttcggcggagggaccaaggtggagatcaaacgaactgtggctgcaccatctgtcttcat

SEQ ID NO: 578617 - DNA, 494 bp, Homo sapiens; identical to SEQ ID NO: 534994
  misc_feature: HIJSMM301DKNUG.27.78.H01.1.454.light.4.raw

SEQ ID NO: 578618 - DNA, 504 bp, Homo sapiens; identical to SEQ ID NO: 555965
  misc_feature: HIJSMM301EBP4B.48.36.D03.1.454.light.4.raw

SEQ ID NO: 578619 - DNA, 486 bp, Homo sapiens
  misc_feature: HIJSMM301CCO4F.43.50.E06.1.454.light.4.raw
tgtgagtagtcacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagagtttcagtacccctctgacgttcggccaagggaccaaggtggaaataaaaacgaaactagtggctgcacc

SEQ ID NO: 578620 - DNA, 483 bp, Homo sapiens
  misc_feature: HIJSMM301CPZO1.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatctcactctcactgtcagcagtctgcaattttgaagatttttgcaacttactactgtcaacagagtttcagtatcccttggacttgtccaacggacgaacgtaggtaagaactaacgaaacgtacgt

SEQ ID NO: 578621 - DNA, 494 bp, Homo sapiens; identical to SEQ ID NO: 534994
  misc_feature: HIJSMM301ETPN7.27.78.H01.1.454.light.4.raw

SEQ ID NO: 578622 - DNA, 519 bp, Homo sapiens
  misc_feature: HIJSMM301EDC3M.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggccaaccccactgtcactctcgttcccaccctcctccgtgt

SEQ ID NO: 578623 - DNA, 513 bp, Homo sapiens
  misc_feature: HIJSMM301AJ2JO.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggccaaggaccgaaggtaggaagtacaaacgaactagtggctgcgaccactctgtcttctactcttcccgtcccact

SEQ ID NO: 578624 - DNA, 508 bp, Homo sapiens
  misc_feature: HIJSMM301B0O5P.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctggtcactctgtt

SEQ ID NO: 578625 - DNA, 489 bp, Homo sapiens; identical to SEQ ID NO: 535139
  misc_feature: HIJSMM301C1Y48.14.55.E11.1.454.light.4.raw

SEQ ID NO: 578626 - DNA, 505 bp, Homo sapiens
  misc_feature: HIJSMM301AMT2P.19.71.G05.1.454.light.4.raw
  modified_base (482)..(482): a, c, t, g, unknown or other
tactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtcggtccgacggaaccgaacggtaggagtatctanacggaactacgtggtcgtgtcga

SEQ ID NO: 578627 - DNA, 487 bp, Homo sapiens
  misc_feature: HIJSMM301EAP6T.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaaacgaactgtggctgcacat

SEQ ID NO: 578628 - DNA, 486 bp, Homo sapiens; identical to SEQ ID NO: 537617
  misc_feature: HIJSMM301EDZ5B.10.53.E09.1.454.light.4.raw

SEQ ID NO: 578629 - DNA, 508 bp, Homo sapiens; identical to SEQ ID NO: 535835
  misc_feature: HIJSMM301CG124.8.34.D01.1.454.light.4.raw

SEQ ID NO: 578630 - DNA, 501 bp, Homo sapiens; identical to SEQ ID NO: 536142
  misc_feature: HIJSMM301DA5R8.15.1.A01.1.454.light.4.raw

SEQ ID NO: 578631 - DNA, 506 bp, Homo sapiens
  misc_feature: HIJSMM301B8MZD.48.87.H10.1.454.light.4.raw
agtatacatacacgaccggtgctcgatttagcagtactgcgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtt

SEQ ID NO: 578632 - DNA, 503 bp, Homo sapiens; identical to SEQ ID NO: 538973
  misc_feature: HIJSMM301A8Q82.5.86.H09.1.454.light.4.raw

SEQ ID NO: 578633 - DNA, 496 bp, Homo sapiens
  misc_feature: HIJSMM301BLFH7.41.82.H05.1.454.light.4.raw
tctatactatcacgaccggtgctcgatttagtcgagctctctcgcgggagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgatttccgtggacgttcggccaagggaccaaggtagaaatcaaacgaactagtggctgcaccatctgtcttcatcttcccgcccta

SEQ ID NO: 578634 - DNA, 489 bp, Homo sapiens; identical to SEQ ID NO: 536919
  misc_feature: HIJSMM301BD7WU.22.86.H09.1.454.light.4.raw

SEQ ID NO: 578635 - DNA, 487 bp, Homo sapiens
  misc_feature: HIJSMM301AI4AR.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccgaagctgaccgtcctaggtcagaccccg

SEQ ID NO: 578636 - DNA, 487 bp, Homo sapiens
  misc_feature: HIJSMM301BCYR9.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcagtttgggtgttcgggcggagggaccaagttgaccgtcctaggtcagcccaaggctcg

SEQ ID NO: 578637 - DNA, 481 bp, Homo sapiens; identical to SEQ ID NO: 535993
  misc_feature: HIJSMM301EMOVH.21.25.C03.1.454.light.4.raw

SEQ ID NO: 578638 - DNA, 484 bp, Homo sapiens; identical to SEQ ID NO: 535400
  misc_feature: HIJSMM301EANGL.46.26.C04.1.454.light.4.raw

SEQ ID NO: 578639 - DNA, 487 bp, Homo sapiens
  misc_feature: HIJSMM301EBSND.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggaggaccaagctgaccgtcctaggtcagcccg

SEQ ID NO: 578640 - DNA, 520 bp, Homo sapiens; identical to SEQ ID NO: 553566
  misc_feature: HIJSMM301C46VA.27.23.C01.1.454.light.4.raw

SEQ ID NO: 578641 - DNA, 444 bp, Homo sapiens; identical to SEQ ID NO: 550016
  misc_feature: HIJSMM301DF5N2.14.76.G10.1.454.light.4.raw

SEQ ID NO: 578642 - DNA, 485 bp, Homo sapiens
  misc_feature: HIJSMM301D3WQ9.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctggctcactttcggcggagggaccaaggtggagatcaaacgaactgtggctgcaccat

SEQ ID NO: 578643 - DNA, 485 bp, Homo sapiens
  misc_feature: HIJSMM301C4XJ1.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggcccaagggacacgactggagattaaacgaactgtggctgcaccat

SEQ ID NO: 578644 - DNA, 507 bp, Homo sapiens; identical to SEQ ID NO: 560339
  misc_feature: HIJSMM301ARPHL.47.83.H06.1.454.light.4.raw

SEQ ID NO: 578645 - DNA, 521 bp, Homo sapiens
  misc_feature: HIJSMM301BSY3Y.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatattacaaccagtgacacttgggtgttcggcggagggaccaggctgaccgtcctaggtcagccaaggctcgcccctcggtcactctgttcccaccct

SEQ ID NO: 578646 - DNA, 504 bp, Homo sapiens
  misc_feature: HIJSMM301AWN9W.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgttcgccacggacgaacgaggagtacaaacgaactagtggctgcaccactctgtctctatcttcccgccact

SEQ ID NO: 578647 - DNA, 511 bp, Homo sapiens
  misc_feature: HIJSMM301AQVI6.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccgaagctgaccgtcctaagtcagcccaaggctgccccctccggtcactctgtt

SEQ ID NO: 578648 - DNA, 463 bp, Homo sapiens; identical to SEQ ID NO: 535008
  misc_feature: HIJSMM301CNQ5C.10.9.A09.1.454.light.4.raw

SEQ ID NO: 578649 - DNA, 487 bp, Homo sapiens; identical to SEQ ID NO: 574426
  misc_feature: HIJSMM301ET79W.46.35.D02.1.454.light.4.raw

SEQ ID NO: 578650 - DNA, 487 bp, Homo sapiens; identical to SEQ ID NO: 539157
  misc_feature: HIJSMM301C9DQ1.26.37.D04.1.454.light.4.raw

SEQ ID NO: 578651 - DNA, 494 bp, Homo sapiens; identical to SEQ ID NO: 534994
  misc_feature: HIJSMM301A5EJH.27.78.H01.1.454.light.4.raw

SEQ ID NO: 578652 - DNA, 492 bp, Homo sapiens
  misc_feature: HIJSMM301E08AG.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaagaactgtggctgcaccatctgtcttcatt

SEQ ID NO: 578653 - DNA, 490 bp, Homo sapiens
  misc_feature: HIJSMM301D8IQF.48.27.C05.1.454.light.4.raw
agtatacatacacgaccggtgctcgatttagacgcgatcgaagggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcacg

SEQ ID NO: 578654 - DNA, 444 bp, Homo sapiens; identical to SEQ ID NO: 544367
  misc_feature: HIJSMM301CD7OP.2.76.G10.1.454.light.4.raw

SEQ ID NO: 578655 - DNA, 494 bp, Homo sapiens; identical to SEQ ID NO: 541400
  misc_feature: HIJSMM301AO6XY.51.71.G05.1.454.light.4.raw

SEQ ID NO: 578656 - DNA, 494 bp, Homo sapiens
  misc_feature: HIJSMM301CK1AQ.49.79.H02.1.454.light.4.raw
agtcgagagacacgaccggtgctcgatttagtgtcacacgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccgggaaggcccctaggttactgatctatgctgcagccaatttgcaaagtggggtcccatcaaggttcagtggcagtggatctgggacagaattcactctcaccatcagcagtctgcaacctgaagattttggaaagtactaattgtcaacagagttacggaaacttgcttcattttcggcggagggaccaaggtggagatcaaacgaactgtggctgcaccatctgtcttcta

SEQ ID NO: 578657 - DNA, 452 bp, Homo sapiens
  misc_feature: HIJSMM301A95HU.13.23.C01.1.454.light.4.raw
tcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgccccatcggtcactctgttcccgccctcctctagtacgtga

SEQ ID NO: 578658 - DNA, 502 bp, Homo sapiens
  misc_feature: HIJSMM301BFJT2.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcact

SEQ ID NO: 578659 - DNA, 485 bp, Homo sapiens; identical to SEQ ID NO: 535985
  misc_feature: HIJSMM301DRLYP.15.1.A01.1.454.light.4.raw

SEQ ID NO: 578660 - DNA, 510 bp, Homo sapiens
  misc_feature: HIJSMM301BYC7Q.9.25.C03.1.454.light.4.raw
tgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcgggtcgaagccgggatgaggccgactatttctgtcagctgtggattctcatgatggtagtgggggaatcttcggcggagggaccaggctgaccgtcctaagtcagccaaggctcgccccctcggtcact

SEQ ID NO: 578661 - DNA, 440 bp, Homo sapiens; identical to SEQ ID NO: 535667
  misc_feature: HIJSMM301BY30D.41.9.A09.1.454.light.4.raw

SEQ ID NO: 578662 - DNA, 509 bp, Homo sapiens
  misc_feature: HIJSMM301EUF0G.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtctcggaactgggaccaaggtcaccgtcctaggtcacgcccaaggcccaacccccactgt

SEQ ID NO: 578663 - DNA, 506 bp, Homo sapiens
  misc_feature: HIJSMM301C9RDP.13.11.A11.1.454.light.4.raw
tcacgtactacacgaccggtgctcgatttagctacgactgcgggtaaggaagggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgttcccc

SEQ ID NO: 578664 - DNA, 481 bp, Homo sapiens
  misc_feature: HIJSMM301C8FDA.48.19.B08.1.454.light.4.raw
  modified_base (446)..(446): a, c, t, g, unknown or other
agtatacatacacgaccggtgctcgatttagtgagtcagtaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggnggaggaccaagctgaccgtcctaggtcagcccaac

SEQ ID NO: 578665 - DNA, 509 bp, Homo sapiens; identical to SEQ ID NO: 539359
  misc_feature: HIJSMM301DT65H.47.85.H08.1.454.light.4.raw

SEQ ID NO: 578666 - DNA, 463 bp, Homo sapiens; identical to SEQ ID NO: 545937
  misc_feature: HIJSMM301DXXF3.17.28.C06.1.454.light.4.raw

SEQ ID NO: 578667 - DNA, 445 bp, Homo sapiens; identical to SEQ ID NO: 537719
  misc_feature: HIJSMM301B23ST.47.85.H08.1.454.light.4.raw

SEQ ID NO: 578668 - DNA, 492 bp, Homo sapiens
  misc_feature: HIJSMM301ADPOZ.40.53.E09.1.454.light.4.raw
tctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcgggggaccgaacgctgaccgtcctaagtc

SEQ ID NO: 578669 - DNA, 513 bp, Homo sapiens; identical to SEQ ID NO: 559561
  misc_feature: HIJSMM301BNQO4.17.33.C11.1.454.light.4.raw
  modified_base (507)..(507): a, c, t, g, unknown or other

SEQ ID NO: 578670 - DNA, 494 bp, Homo sapiens; identical to SEQ ID NO: 534992
  misc_feature: HIJSMM301A4ISN.9.1.A01.1.454.light.4.raw

SEQ ID NO: 578671 - DNA, 520 bp, Homo sapiens; identical to SEQ ID NO: 539176
  misc_feature: HIJSMM301C46YI.27.23.C01.1.454.light.4.raw

SEQ ID NO: 578672 - DNA, 382 bp, Homo sapiens
  misc_feature: HIJSMM301AV7NF.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataa

SEQ ID NO: 578673 - DNA, 466 bp, Homo sapiens; identical to SEQ ID NO: 536398
  misc_feature: HIJSMM301D1FW4.3.20.B09.1.454.light.4.raw

SEQ ID NO: 578674 - DNA, 484 bp, Homo sapiens; identical to SEQ ID NO: 538094
  misc_feature: HIJSMM301BOINF.3.10.A10.1.454.light.4.raw

SEQ ID NO: 578675 - DNA, 504 bp, Homo sapiens; identical to SEQ ID NO: 535077
  misc_feature: HIJSMM301EKVZB.8.28.C06.1.454.light.4.raw

SEQ ID NO: 578676 - DNA, 488 bp, Homo sapiens; identical to SEQ ID NO: 535990
  misc_feature: HIJSMM301BU62K.11.28.C06.1.454.light.4.raw

SEQ ID NO: 578677 - DNA, 454 bp, Homo sapiens; identical to SEQ ID NO: 535005
  misc_feature: HIJSMM301AEJMJ.19.86.H09.1.454.light.4.raw

SEQ ID NO: 578678 - DNA, 482 bp, Homo sapiens
  misc_feature: HIJSMM301D4FE2.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcgcgggggaccaaggtggagatcaaacgaactgtggctgcaccta

SEQ ID NO: 578679 - DNA, 487 bp, Homo sapiens; identical to SEQ ID NO: 535863
  misc_feature: HIJSMM301D3MN4.19.71.G05.1.454.light.4.raw

SEQ ID NO: 578680 - DNA, 481 bp, Homo sapiens
  misc_feature: HIJSMM301CT0KV.49.82.H05.1.454.light.4.raw
agtcgagagacacgaccggtgctcgatttagtcgagctctctcgcgggcacgaccggtgctcgatttagtacagatcgttagggaaaggggactgatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagct

SEQ ID NO: 578681 - DNA, 491 bp, Homo sapiens; identical to SEQ ID NO: 535294
  misc_feature: HIJSMM301A52K3.16.68.G02.1.454.light.4.raw

SEQ ID NO: 578682 - DNA, 483 bp, Homo sapiens; identical to SEQ ID NO: 572112
  misc_feature: HIJSMM301CT5CU.10.1.A01.1.454.light.4.raw

SEQ ID NO: 578683 - DNA, 483 bp, Homo sapiens; identical to SEQ ID NO: 544786
  misc_feature: HIJSMM301B2P7O.46.26.C04.1.454.light.4.raw

SEQ ID NO: 578684 - DNA, 508 bp, Homo sapiens; identical to SEQ ID NO: 541988
  misc_feature: HIJSMM301BJ94V.5.60.F05.1.454.light.4.raw

SEQ ID NO: 578685 - DNA, 496 bp, Homo sapiens
  misc_feature: HIJSMM301C2DYL.41.16.B05.1.454.light.4.raw
tctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgctagtttattactgtcaccaatataataactggtactactttggccaggggaccaagctcgagatacaaacgaactgtggctgcaccatctgtcttcatccttcccg

SEQ ID NO: 578686 - DNA, 513 bp, Homo sapiens
  misc_feature: HIJSMM301AV8XL.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttccg

SEQ ID NO: 578687 - DNA, 497 bp, Homo sapiens
  misc_feature: HIJSMM301BABR7.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggagatacaaacgaactgtggctgctaccatctgtcttcactt

SEQ ID NO: 578688 - DNA, 494 bp, Homo sapiens; identical to SEQ ID NO: 534992
  misc_feature: HIJSMM301BIL0I.9.1.A01.1.454.light.4.raw

SEQ ID NO: 578689 - DNA, 489 bp, Homo sapiens
  misc_feature: HIJSMM301EP4HT.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttgccaagggaccaagctggagatcaaacgaactgtggctgcaccta

SEQ ID NO: 578690 - DNA, 509 bp, Homo sapiens; identical to SEQ ID NO: 539359
  misc_feature: HIJSMM301EZ9IV.47.85.H08.1.454.light.4.raw

SEQ ID NO: 578691 - DNA, 511 bp, Homo sapiens
  misc_feature: HIJSMM301A6091.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcagggtgtgggatagtagtcgtgagcatgtggtattcggcggagggaccaaactgaccgtcctaggtcagcccaaggctgccccctcggtcactctgtt

SEQ ID NO: 578692 - DNA, 479 bp, Homo sapiens; identical to SEQ ID NO: 545213
  misc_feature: HIJSMM301E040I.40.59.F04.1.454.light.4.raw

SEQ ID NO: 578693 - DNA, 454 bp, Homo sapiens; identical to SEQ ID NO: 535005
  misc_feature: HIJSMM301B69DS.19.86.H09.1.454.light.4.raw

SEQ ID NO: 578694 - DNA, 502 bp, Homo sapiens; identical to SEQ ID NO: 561032
  misc_feature: HIJSMM301CRJ6C.48.35.D02.1.454.light.4.raw

SEQ ID NO: 578695 - DNA, 483 bp, Homo sapiens; identical to SEQ ID NO: 578573
  misc_feature: HIJSMM301ANU80.4.41.D08.1.454.light.4.raw

SEQ ID NO: 578696 - DNA, 479 bp, Homo sapiens
  misc_feature: HIJSMM301AOIO0.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcgcgggggaccaaggtggagatcaacgaactgtggctgcacca

SEQ ID NO: 578697 - DNA, 485 bp, Homo sapiens
  misc_feature: HIJSMM301A1W0I.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccgaaactgaccgtcctaggtcagcccaaggctgcccccc

SEQ ID NO: 578698 - DNA, 465 bp, Homo sapiens; identical to SEQ ID NO: 538589
  misc_feature: HIJSMM301BRA0B.12.39.D06.1.454.light.4.raw

SEQ ID NO: 578699 - DNA, 494 bp, Homo sapiens
  misc_feature: HIJSMM301DFLFH.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggtacttttggccaggggaccaagctggagatcaaacgaactgtggctgcaccatctgtctt

SEQ ID NO: 578700 - DNA, 482 bp, Homo sapiens; identical to SEQ ID NO: 535697
  misc_feature: HIJSMM301CC0E3.13.8.A08.1.454.light.4.raw

SEQ ID NO: 578701 - DNA, 507 bp, Homo sapiens
  misc_feature: HIJSMM301CVA3N.19.78.H01.1.454.light.4.raw
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaaagcggccctcaggggtttctaatcgcttctctggctccaagtctggcaacacggctccctgacaatctctgggctccaggctgaggacgaggctgattactactgctgctcatatgcaggtcgtatctcttatgtcttcggaactgggaccaaggtcaccgtctaggtcagcccaaggcccaaccccactgtcta

SEQ ID NO: 578702 - DNA, 485 bp, Homo sapiens; identical to SEQ ID NO: 535501
  misc_feature: HIJSMM301D0B7E.3.10.A10.1.454.light.4.raw

SEQ ID NO: 578703 - DNA, 494 bp, Homo sapiens; identical to SEQ ID NO: 534992
  misc_feature: HIJSMM301ENOGA.9.1.A01.1.454.light.4.raw

SEQ ID NO: 578704 - DNA, 489 bp, Homo sapiens; identical to SEQ ID NO: 540424
  misc_feature: HIJSMM301DAT55.17.25.C03.1.454.light.4.raw

SEQ ID NO: 578705 - DNA, 513 bp, Homo sapiens
  misc_feature: HIJSMM301CLWFF.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaagggaccgaacggtaggaagtacaaacgaactagtggctgcgaccatctgtcttctactcttcccgccact

SEQ ID NO: 578706 - DNA, 469 bp, Homo sapiens
  misc_feature: HIJSMM301B5T7X.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagatttgcaatttattactgtctgcaggattacacataccctcgaacgttcggccaagggaccaaggtggaaatcaaacgaactgt

SEQ ID NO: 578707 - DNA, 447 bp, Homo sapiens; identical to SEQ ID NO: 535950
  misc_feature: HIJSMM301BC7PL.18.9.A09.1.454.light.4.raw

SEQ ID NO: 578708 - DNA, 488 bp, Homo sapiens
  misc_feature: HIJSMM301EE35Q.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaagctggagatcaggcgtaacg

SEQ ID NO: 578709 - DNA, 478 bp, Homo sapiens
  misc_feature: HIJSMM301CBNBK.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggcctcaggggtccctgaccgattctctggctccaagtctggcacctcagcctccctggtcatcgctgggctccagctgacgatgaggctgattattattgccagtcctatgacaacacctgcgtggttttggctgttcggcggcgggacc

SEQ ID NO: 578710 - DNA, 496 bp, Homo sapiens; identical to SEQ ID NO: 538149
  misc_feature: HIJSMM301ECD9N.13.67.G01.1.454.light.4.raw

SEQ ID NO: 578711 - DNA, 447 bp, Homo sapiens; identical to SEQ ID NO: 535020
  misc_feature: HIJSMM301AKE9V.18.9.A09.1.454.light.4.raw

SEQ ID NO: 578712 - DNA, 500 bp, Homo sapiens
  misc_feature: HIJSMM301DID5D.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtccgtaggtcagcccaaggct

SEQ ID NO: 578713 - DNA, 484 bp, Homo sapiens
  misc_feature: HIJSMM301EZ18V.19.57.F02.1.454.light.4.raw
  modified_base (444)..(444): a, c, t, g, unknown or other
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacacttcccctcacttcgcggngggacgagtggagatcaagcgaactagtggctgcaccact

SEQ ID NO: 578714 - DNA, 482 bp, Homo sapiens
  misc_feature: HIJSMM301D2PSU.3.33.C11.1.454.light.4.raw
  modified_base (427)..(427): a, c, t, g, unknown or other
agacgcactccacgaccggtgctcgatttagagtgagctcgttgggtttggggagtcagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgatgattttgcaacttattactgccaaacagtataataccccgngttgacgttcggccaagggaccaaggtggaggatcatacgaactgtggctgcacc

SEQ ID NO: 578715 - DNA, 503 bp, Homo sapiens; identical to SEQ ID NO: 553138
  misc_feature: HIJSMM301CO90Z.22.15.B04.1.454.light.4.raw

SEQ ID NO: 578716 - DNA, 492 bp, Homo sapiens; identical to SEQ ID NO: 553212
  misc_feature: HIJSMM301EHOKM.16.78.H01.1.454.light.4.raw

SEQ ID NO: 578717 - DNA, 478 bp, Homo sapiens
  misc_feature: HIJSMM301A0IAM.49.27.C05.1.454.light.4.raw
agtcgagagacacgaccggtgctcgatttagacgcgatcgaagggttggggcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcacgttcggtcgggggaccgaacggtggtagatcaagacgaactgtggctgca

SEQ ID NO: 578718 - DNA, 519 bp, Homo sapiens; identical to SEQ ID NO: 548902
  misc_feature: HIJSMM301BXH55.27.23.C01.1.454.light.4.raw

SEQ ID NO: 578719 - DNA, 481 bp, Homo sapiens
  misc_feature: HIJSMM301DZEP9.8.14.B03.1.454.light.4.raw
ctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggagtcctcccactatctcctgaggtataaaacagactcagataaggagcaggcctctggagtccccagccgcttctctggatccaaagatgctgcggccaatgcagggagtttgctcatctctgggctccagtttgaggatgaggctgactattattgtatgatttggtacaggagcgcttgggtgatcggcggagggaccaagctgaccgtcctaggtcagcccaa

SEQ ID NO: 578720 - DNA, 498 bp, Homo sapiens; identical to SEQ ID NO: 536977
  misc_feature: HIJSMM301ALYTP.11.75.G09.1.454.light.4.raw

SEQ ID NO: 578721 - DNA, 502 bp, Homo sapiens
  misc_feature: HIJSMM301B7EXE.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttccgcc

SEQ ID NO: 578722 - DNA, 504 bp, Homo sapiens
  misc_feature: HIJSMM301BO17W.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaactacacacggccgctcactttcggcggagggaccaaggtggagatcaaacgaactgtggctgcaccatctgt

SEQ ID NO: 578723 - DNA, 493 bp, Homo sapiens; identical to SEQ ID NO: 535657
  misc_feature: HIJSMM301B174U.27.78.H01.1.454.light.4.raw

SEQ ID NO: 578724 - DNA, 486 bp, Homo sapiens; identical to SEQ ID NO: 535385
  misc_feature: HIJSMM301DQ5Y6.19.71.G05.1.454.light.4.raw

SEQ ID NO: 578725 - DNA, 485 bp, Homo sapiens; identical to SEQ ID NO: 535880
  misc_feature: HIJSMM301DLSF4.7.75.G09.1.454.light.4.raw

SEQ ID NO: 578726 - DNA, 504 bp, Homo sapiens; identical to SEQ ID NO: 556745
  misc_feature: HIJSMM301C41GZ.16.49.E05.1.454.light.4.raw

SEQ ID NO: 578727 - DNA, 503 bp, Homo sapiens
  misc_feature: HIJSMM301EVVLW.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacacgcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaaacatacttttgtcttcggaactggaccaaggtcaccgtctaggtcagccaaggccaacccactgtcact

SEQ ID NO: 578728 - DNA, 454 bp, Homo sapiens; identical to SEQ ID NO: 536846
  misc_feature: HIJSMM301EN256.18.78.H01.1.454.light.4.raw

SEQ ID NO: 578729 - DNA, 504 bp, Homo sapiens
  misc_feature: HIJSMM301A9VUS.48.26.C04.1.454.light.4.raw
agtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaagggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctcggt

SEQ ID NO: 578730 - DNA, 502 bp, Homo sapiens; identical to SEQ ID NO: 536253
  misc_feature: HIJSMM301DQ40V.21.22.B11.1.454.light.4.raw

SEQ ID NO: 578731 - DNA, 487 bp, Homo sapiens; identical to SEQ ID NO: 536536
  misc_feature: HIJSMM301A28B6.26.45.E01.1.454.light.4.raw

SEQ ID NO: 578732 - DNA, 491 bp, Homo sapiens; identical to SEQ ID NO: 535176
  misc_feature: HIJSMM301BC6JQ.13.39.D06.1.454.light.4.raw

SEQ ID NO: 578733 - DNA, 494 bp, Homo sapiens
  misc_feature: HIJSMM301CI6ML.52.68.G02.1.454.light.4.raw
cgcagtacgacacgaccggtgctcgatttagtcgatagtgaagggaaagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcacgtcctaggtcagcccaaggccaacccactgtca

SEQ ID NO: 578734 - DNA, 494 bp, Homo sapiens
  misc_feature: HIJSMM301D0K1G.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatcggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggcctaggggaccaaactggagtatcagacgaactgtaggctgca

SEQ ID NO: 578735 - DNA, 495 bp, Homo sapiens; identical to SEQ ID NO: 535486
  misc_feature: HIJSMM301A2W7E.26.72.G06.1.454.light.4.raw

SEQ ID NO: 578736 - DNA, 512 bp, Homo sapiens
  misc_feature: HIJSMM301BY1KH.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaattaggcgccactctcgtggttttcggcggaggcaccgaagtgaccgtcctcggtcagcccaaggctgccccctcggtcact

SEQ ID NO: 578737 - DNA, 509 bp, Homo sapiens; identical to SEQ ID NO: 541829
  misc_feature: HIJSMM301CCB29.17.28.C06.1.454.light.4.raw

SEQ ID NO: 578738 - DNA, 494 bp, Homo sapiens
  misc_feature: HIJSMM301B2853.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagaaccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactagtggctgcaccatctgtcttcatcttcccg

SEQ ID NO: 578739 - DNA, 495 bp, Homo sapiens
  misc_feature: HIJSMM301DX8TT.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagtattttgctagtttattactgtcagcagtataatgactgggttttattcactttcggccctgggaccaaagtggtatttcagacgaactgtggctgcaccatctgtcttcta

SEQ ID NO: 578740 - DNA, 457 bp, Homo sapiens
  misc_feature: HIJSMM301DP3IP.10.86.H09.1.454.light.4.raw
catagtagtgcacgaccggtgctcgatttagtgctatagacttgggtttgggggctgtcccggggaagtgctggtaccaggatacataattcgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgcccctcggtcactctgttcccacctcctccactactatg

SEQ ID NO: 578741 - DNA, 507 bp, Homo sapiens; identical to SEQ ID NO: 535641
  misc_feature: HIJSMM301BO9V1.10.88.H11.1.454.light.4.raw

SEQ ID NO: 578742 - DNA, 515 bp, Homo sapiens
  misc_feature: HIJSMM301AVQ5Y.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgcatatttttgtcaggtgtgggagactaattttggtcatatgttgttcggcggagggaccaagctgaccgtcctcggtcagcccaaggctgccccctcggtcactctcgttcccgccct

SEQ ID NO: 578743 - DNA, 509 bp, Homo sapiens
  misc_feature: HIJSMM301BIAHR.10.71.G05.1.454.light.4.raw
catagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactagtggctgcaccatctgtcttcatcttccccg

SEQ ID NO: 578744 - DNA, 504 bp, Homo sapiens
  misc_feature: HIJSMM301C7JDH.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggtcccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtcactctcgtt

SEQ ID NO: 578745 - DNA, 493 bp, Homo sapiens; identical to SEQ ID NO: 536969
  misc_feature: HIJSMM301A597I.27.78.H01.1.454.light.4.raw

SEQ ID NO: 578746 - DNA, 494 bp, Homo sapiens
  misc_feature: HIJSMM301EN2BK.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtggaaatcaaacgactgtggctgcacc

SEQ ID NO: 578747 - DNA, 518 bp, Homo sapiens; identical to SEQ ID NO: 539372
  misc_feature: HIJSMM301A9DUC.7.86.H09.1.454.light.4.raw

SEQ ID NO: 578748 - DNA, 494 bp, Homo sapiens
  misc_feature: HIJSMM301EZ0XW.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtgaaatcaaacgactgtggctgcacc

SEQ ID NO: 578749 - DNA, 505 bp, Homo sapiens; identical to SEQ ID NO: 539292
  misc_feature: HIJSMM301DPL06.19.85.H08.1.454.light.4.raw

SEQ ID NO: 578750 - DNA, 486 bp, Homo sapiens; identical to SEQ ID NO: 535917
  misc_feature: HIJSMM301CYZ8K.3.10.A10.1.454.light.4.raw

SEQ ID NO: 578751 - DNA, 486 bp, Homo sapiens
  misc_feature: HIJSMM301AL0DJ.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccaccgttcggcggagggaccacagtcgagatacaaacgaactgtggctgcaccat

SEQ ID NO: 578752 - DNA, 454 bp, Homo sapiens; identical to SEQ ID NO: 536943
  misc_feature: HIJSMM301APC1N.19.86.H09.1.454.light.4.raw

SEQ ID NO: 578753 - DNA, 478 bp, Homo sapiens
  misc_feature: HIJSMM301ECLID.17.39.D06.1.454.light.4.raw
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctcgtggacgttcggccaaggaccaaggtggaaatcaaacgaactgtgg

SEQ ID NO: 578754 - DNA, 515 bp, Homo sapiens
  misc_feature: HIJSMM301DOU1Q.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccccg

SEQ ID NO: 578755 - DNA, 441 bp, Homo sapiens; identical to SEQ ID NO: 534971
  misc_feature: HIJSMM301A4L9F.11.3.A03.1.454.light.4.raw

SEQ ID NO: 578756 - DNA, 497 bp, Homo sapiens; identical to SEQ ID NO: 534982
  misc_feature: HIJSMM301DHFVZ.26.80.H03.1.454.light.4.raw

SEQ ID NO: 578757 - DNA, 504 bp, Homo sapiens
  misc_feature: HIJSMM301DAGBN.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtgtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaataagaggtcaaacgaaactgtggctgcaccatctgtcttcatt

SEQ ID NO: 578758 - DNA, 501 bp, Homo sapiens; identical to SEQ ID NO: 536142
  misc_feature: HIJSMM301DJ9BJ.15.1.A01.1.454.light.4.raw

SEQ ID NO: 578759 - DNA, 492 bp, Homo sapiens
  misc_feature: HIJSMM301BUC1H.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcaggtgggtttgggacagagttcactctcaccatcagcagcctgcagtctgaagattttgctagtttattactgtcagcagtataataactggcctccggtcactttcggcggagggaccgaaggtggagatcaaacgaactgtggctgcaccat

SEQ ID NO: 578760 - DNA, 503 bp, Homo sapiens
  misc_feature: HIJSMM301E22RQ.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaatatttttctatcctccgtggacgttcggccaagggaccagggtggaaatcagacgaactgtggctgcaccatctgtctt

SEQ ID NO: 578761 - DNA, 480 bp, Homo sapiens; identical to SEQ ID NO: 549459
  misc_feature: HIJSMM301BQQTV.21.25.C03.1.454.light.4.raw

SEQ ID NO: 578762 - DNA, 488 bp, Homo sapiens
  misc_feature: HIJSMM301CASMR.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtaccagttttggccaggggaccaagctggagatcaaacgaactagtgg

SEQ ID NO: 578763 - DNA, 489 bp, Homo sapiens
  misc_feature: HIJSMM301B41RK.9.59.F04.1.454.light.4.raw
  modified_base (197)..(197): a, c, t, g, unknown or other
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctcgcccccaaccttcggccaggggacacgactggagattaaacgaactgtggctgcaccat

SEQ ID NO: 578764 - DNA, 491 bp, Homo sapiens; identical to SEQ ID NO: 535294
  misc_feature: HIJSMM301A1239.16.68.G02.1.454.light.4.raw

SEQ ID NO: 578765 - DNA, 497 bp, Homo sapiens; identical to SEQ ID NO: 535740
  misc_feature: HIJSMM301EPI25.3.71.G05.1.454.light.4.raw

SEQ ID NO: 578766 - DNA, 443 bp, Homo sapiens; identical to SEQ ID NO: 546137
  misc_feature: HIJSMM301CYL5Q.9.9.A09.1.454.light.4.raw

SEQ ID NO: 578767 - DNA, 503 bp, Homo sapiens; identical to SEQ ID NO: 538884
  misc_feature: HIJSMM301ASWJZ.27.78.H01.1.454.light.4.raw

SEQ ID NO: 578768 - DNA, 517 bp, Homo sapiens
  misc_feature: HIJSMM301DYR9N.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctcgccccctcggtcactctgttcccaccctcctccg

SEQ ID NO: 578769 - DNA, 493 bp, Homo sapiens
  misc_feature: HIJSMM301APNYL.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttacccccggacgtcgctcgggaccgacggtggagtgtcgtaagacgacgtacgtggcgtcgtcgccac

SEQ ID NO: 578770 - DNA, 444 bp, Homo sapiens; identical to SEQ ID NO: 535192
  misc_feature: HIJSMM301D2ZOB.5.9.A09.1.454.light.4.raw

SEQ ID NO: 578771 - DNA, 478 bp, Homo sapiens; identical to SEQ ID NO: 541928
  misc_feature: HIJSMM301D9YOF.7.76.G10.1.454.light.4.raw

SEQ ID NO: 578772 - DNA, 498 bp, Homo sapiens; identical to SEQ ID NO: 544837
  misc_feature: HIJSMM301A8RAJ.11.71.G05.1.454.light.4.raw

SEQ ID NO: 578773 - DNA, 516 bp, Homo sapiens
  misc_feature: HIJSMM301DIWCS.53.20.B09.1.454.light.4.raw
cgcgtatacacacgaccggtgctcgatttagtgtagtgtgaaggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggcggagggaccaagctgaccgtcctaggtcagcccaaggctgccccctcggtcactctgttcccgccctcctctcgta

SEQ ID NO: 578774 - DNA, 513 bp, Homo sapiens; identical to SEQ ID NO: 535244
  misc_feature: HIJSMM301BUPGC.17.33.C11.1.454.light.4.raw

SEQ ID NO: 578775 - DNA, 445 bp, Homo sapiens
  misc_feature: HIJSMM301EY289.2.76.G10.1.454.light.4.raw
  modified_base (427)..(427): a, c, t, g, unknown or other
acgctcgacacacgaccggtgctcgatttagtcactcatacagggtcctgggcccagtctgtgctgactcagccaccctcagcgtctgggcccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccnccctcctctgtcgagcgt

SEQ ID NO: 578776 - DNA, 509 bp, Homo sapiens
  misc_feature: HIJSMM301EVNH2.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaaggctgaccgtcctaggtcagcccaaggctgccccccg

SEQ ID NO: 578777 - DNA, 465 bp, Homo sapiens; identical to SEQ ID NO: 538589
  misc_feature: HIJSMM301AZX1Z.12.39.D06.1.454.light.4.raw

SEQ ID NO: 578778 - DNA, 478 bp, Homo sapiens
  misc_feature: HIJSMM301BP5YY.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctg

SEQ ID NO: 578779 - DNA, 447 bp, Homo sapiens; identical to SEQ ID NO: 535201
  misc_feature: HIJSMM301BL373.18.9.A09.1.454.light.4.raw

SEQ ID NO: 578780 - DNA, 479 bp, Homo sapiens
  misc_feature: HIJSMM301BKE8G.4.12.B01.1.454.light.4.raw
agcactgtagcacgaccggtgctcgatttagtagtgtagattccgcgggaggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcac

SEQ ID NO: 578781 - DNA, 500 bp, Homo sapiens
  misc_feature: HIJSMM301A5NUN.48.19.B08.1.454.light.4.raw
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcactaagcggccctcgggggtccctgatcgcttctctggctccaagtctggcaacacggcctccctgaccatctctgggctccaggctgaagatcaggctgattattactgctgttcattttcaagtttcctttttgtcttcggaactgggaccgaggtcaccgtcctaggtcagcccaaggccaacccactgtcact

SEQ ID NO: 578782 - DNA, 485 bp, Homo sapiens; identical to SEQ ID NO: 539041
  misc_feature: HIJSMM301C5UM6.46.26.C04.1.454.light.4.raw

SEQ ID NO: 578783 - DNA, 482 bp, Homo sapiens; identical to SEQ ID NO: 535920
  misc_feature: HIJSMM301CVKEI.19.71.G05.1.454.light.4.raw

SEQ ID NO: 578784 - DNA, 506 bp, Homo sapiens
  misc_feature: HIJSMM301ERQ43.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctggaggacgaggctgatttattactgcagctcatatacaagcaccagcactctctatgtcttcggaactgggaccaaggtcaccgtcctaggtccagcccaaggccaaccccc

SEQ ID NO: 578785 - DNA, 491 bp, Homo sapiens; identical to SEQ ID NO: 542310
  misc_feature: HIJSMM301ELVX3.22.65.F10.1.454.light.4.raw

SEQ ID NO: 578786 - DNA, 492 bp, Homo sapiens
  misc_feature: HIJSMM301DACW7.4.57.F02.1.454.light.4.raw
agcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgcctcactttcgtcggaggaccgaaggtaggagatacaaacgaactagtggtctgcaccact

SEQ ID NO: 578787 - DNA, 499 bp, Homo sapiens
  misc_feature: HIJSMM301CFR4O.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagaccaccctgtctgtgtctccaggggaaagagccaccctctcctgcagggccagtcagagtattagcagcaaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 578788 - DNA, 489 bp, Homo sapiens; identical to SEQ ID NO: 535776
  misc_feature: HIJSMM301D3I2Y.4.52.E08.1.454.light.4.raw

SEQ ID NO: 578789 - DNA, 495 bp, Homo sapiens
  misc_feature: HIJSMM301CBMWC.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaaagccccagacctcctgatctctggtgcatccactctgcgaagtggcgtcccatcgaggttcagtggcagtggatctgggacagatttcaaatctcaccatcaccactctgcaacctgaggattgtgcaatctactactgtcaacagagttacagttcccctcgcacttttggcctaggggaccgaaagttagagatcaaaacgaactagtggctgcaccatctgt

SEQ ID NO: 578790 - DNA, 505 bp, Homo sapiens
  misc_feature: HIJSMM301APOMZ.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccgccct

SEQ ID NO: 578791 - DNA, 486 bp, Homo sapiens; identical to SEQ ID NO: 535043
  misc_feature: HIJSMM301DLM5R.46.35.D02.1.454.light.4.raw

SEQ ID NO: 578792 - DNA, 529 bp, Homo sapiens
  misc_feature: HIJSMM301ESDLY.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctaccctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttacccttctcccccggacgttcggtccgaacggaccgaacggtagggtaaagtacgtaacgacggaacgtacgtggcgtgcgaccaatctgtcgttcactcttccccg

SEQ ID NO: 578793 - DNA, 506 bp, Homo sapiens; identical to SEQ ID NO: 554661
  misc_feature: HIJSMM301C83XP.3.79.H02.1.454.light.4.raw

SEQ ID NO: 578794 - DNA, 527 bp, Homo sapiens
  misc_feature: HIJSMM301CM5JL.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaaggtacgaaacgaaacctagtggctgcaccactctgtcttctatcttcccgtccactctcgat

SEQ ID NO: 578795 - DNA, 488 bp, Homo sapiens; identical to SEQ ID NO: 535081
  misc_feature: HIJSMM301CZ5WC.26.23.C01.1.454.light.4.raw

SEQ ID NO: 578796 - DNA, 525 bp, Homo sapiens
  misc_feature: HIJSMM301AZOPZ.53.77.G11.1.454.light.4.raw
cgcgtatacacacgaccggtgctcgatttagctagtcactcaagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtggggaccaggctgaccgtcctaggtcagcccaaggctgccccctcggtcactctgttcccaccctcctctcg

SEQ ID NO: 578797 - DNA, 497 bp, Homo sapiens
  misc_feature: HIJSMM301C1CPI.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaaacactgttttcggcggagggaccaagctgaccgtcctaggtcagcccaaggctgccccctcggtcactctgttcccgccctcctcgagtgcgtct

SEQ ID NO: 578798 - DNA, 507 bp, Homo sapiens
  misc_feature: HIJSMM301B46S1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaaggaccgaaggtaggaaagtacaaacgaactagtggcgtgcaccatctgtcttcatctccccg

SEQ ID NO: 578799 - DNA, 494 bp, Homo sapiens
  misc_feature: HIJSMM301AMPG6.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccactgtcactcttccg

SEQ ID NO: 578800 - DNA, 489 bp, Homo sapiens; identical to SEQ ID NO: 546040
  misc_feature: HIJSMM301CDZR7.11.12.B01.1.454.light.4.raw

SEQ ID NO: 578801 - DNA, 497 bp, Homo sapiens; identical to SEQ ID NO: 534982
  misc_feature: HIJSMM301AX2ZX.26.80.H03.1.454.light.4.raw

SEQ ID NO: 578802 - DNA, 493 bp, Homo sapiens
  misc_feature: HIJSMM301BRWXL.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggacggagatcagacgaactagtggctgcaccactctgtcttcta

SEQ ID NO: 578803 - DNA, 478 bp, Homo sapiens
  misc_feature: HIJSMM301AT17O.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagacaatatgattttgctcctccgagtcgcctacttttgggcgggggaccaaggtcggacatacgaaacgaa

SEQ ID NO: 578804 - DNA, 481 bp, Homo sapiens
  misc_feature: HIJSMM301BUHES.15.8.A08.1.454.light.4.raw
  modified_base (476)..(476): a, c, t, g, unknown or other
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatcttccgccatctganctacg

SEQ ID NO: 578805 - DNA, 503 bp, Homo sapiens; identical to SEQ ID NO: 562022
  misc_feature: HIJSMM301CKNLB.21.81.H04.1.454.light.4.raw

SEQ ID NO: 578806 - DNA, 491 bp, Homo sapiens
  misc_feature: HIJSMM301DDF8R.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgcaggctgaagatgtggcagtttattactgtcagcaatattatagtactcctccgaggctcactttcgggcggagggaccaaggtggagatcaaacgaactgtgg

SEQ ID NO: 578807 - DNA, 486 bp, Homo sapiens; identical to SEQ ID NO: 535385
  misc_feature: HIJSMM301CJ192.19.71.G05.1.454.light.4.raw

SEQ ID NO: 578808 - DNA, 488 bp, Homo sapiens; identical to SEQ ID NO: 536851
  misc_feature: HIJSMM301BTDEA.41.2.A02.1.454.light.4.raw

SEQ ID NO: 578809 - DNA, 445 bp, Homo sapiens; identical to SEQ ID NO: 542143
  misc_feature: HIJSMM301CAR3R.47.85.H08.1.454.light.4.raw

SEQ ID NO: 578810 - DNA, 494 bp, Homo sapiens; identical to SEQ ID NO: 534992
  misc_feature: HIJSMM301BKBRB.9.1.A01.1.454.light.4.raw

SEQ ID NO: 578811 - DNA, 513 bp, Homo sapiens
  misc_feature: HIJSMM301DKNHT.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccaccaggttcagtggcagtgggtctgggacagacttcattctcaccatccgcagcctagagcctgaagattttgctagtttattactgtcaacagcgtagcagcaggcctccggcgacgttcggccaagggaccaaggtaggagtcaagcgaactgtggctgcaccatctgttcttctatcttcccgccact

SEQ ID NO: 578812 - DNA, 489 bp, Homo sapiens; identical to SEQ ID NO: 535139
  misc_feature: HIJSMM301A2SFE.14.55.E11.1.454.light.4.raw

SEQ ID NO: 578813 - DNA, 477 bp, Homo sapiens; identical to SEQ ID NO: 535506
  misc_feature: HIJSMM301AJ098.7.67.G01.1.454.light.4.raw

SEQ ID NO: 578814 - DNA, 495 bp, Homo sapiens
  misc_feature: HIJSMM301CGEMN.51.45.E01.1.454.light.4.raw
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaaacgaactgtggctgcaccta

SEQ ID NO: 578815 - DNA, 494 bp, Homo sapiens
  misc_feature: HIJSMM301CVKNF.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtgctgcac

SEQ ID NO: 578816 - DNA, 485 bp, Homo sapiens; identical to SEQ ID NO: 538954
  misc_feature: HIJSMM301AVK2M.3.55.E11.1.454.light.4.raw

SEQ ID NO: 578817 - DNA, 500 bp, Homo sapiens
  misc_feature: HIJSMM301BKRB1.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtctaggt

SEQ ID NO: 578818 - DNA, 506 bp, Homo sapiens; identical to SEQ ID NO: 549457
  misc_feature: HIJSMM301DS2M2.4.10.A10.1.454.light.4.raw

SEQ ID NO: 578819 - DNA, 485 bp, Homo sapiens
  misc_feature: HIJSMM301DN9QF.13.81.H04.1.454.light.4.raw
tcacgtactacacgaccggtgctcgatttagtagtgtagattcgcggggggggtctcaggaggcagcgctctcgggacgtctccaccatggcctgggctctgctattcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtcctaggtcagcccaa

SEQ ID NO: 578820 - DNA, 502 bp, Homo sapiens
  misc_feature: HIJSMM301CO2BK.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcaacatcgtaccgagtggcctccggggccactttcggccctgggaccaaattgagatcaaacgaactgtggctgcaccatctgtcttcatcttcccgcc

SEQ ID NO: 578821 - DNA, 494 bp, Homo sapiens; identical to SEQ ID NO: 535276
  misc_feature: HIJSMM301EVWQB.16.6.A06.1.454.light.4.raw

SEQ ID NO: 578822 - DNA, 505 bp, Homo sapiens
  misc_feature: HIJSMM301AVQQ6.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccagacaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgactaatttggtgttcggcggagggaccaagctgaccgtcctaggtcagcccaaggctcgccccctcggtcta

SEQ ID NO: 578823 - DNA, 499 bp, Homo sapiens
  misc_feature: HIJSMM301AT7MG.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttggggctctattaattgcatgcaagctctacaaagtcccgcctcactttcggtcggacggggacgaacggtaggagagtacaaacgaaacta

SEQ ID NO: 578824 - DNA, 495 bp, Homo sapiens
  misc_feature: HIJSMM301A810U.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcacgtttcggcggagggaccagggtggagatcaaacgaactgtggctgcacccatctgtcttcatt

SEQ ID NO: 578825 - DNA, 505 bp, Homo sapiens; identical to SEQ ID NO: 535987
  misc_feature: HIJSMM301DZ7MB.18.37.D04.1.454.light.4.raw

SEQ ID NO: 578826 - DNA, 488 bp, Homo sapiens; identical to SEQ ID NO: 542699
  misc_feature: HIJSMM301AP40F.12.51.E07.1.454.light.4.raw

SEQ ID NO: 578827 - DNA, 499 bp, Homo sapiens; identical to SEQ ID NO: 560695
  misc_feature: HIJSMM301BGS8T.2.34.D01.1.454.light.4.raw

SEQ ID NO: 578828 - DNA, 492 bp, Homo sapiens
  misc_feature: HIJSMM301AWNW0.49.61.F06.1.454.light.4.raw
agtcgagagacacgaccggtgctcgatttagctacgctctaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 578829 - DNA, 485 bp, Homo sapiens; identical to SEQ ID NO: 535985
  misc_feature: HIJSMM301E1K0Q.15.1.A01.1.454.light.4.raw

SEQ ID NO: 578830 - DNA, 494 bp, Homo sapiens; identical to SEQ ID NO: 534994
  misc_feature: HIJSMM301CJCHZ.27.78.H01.1.454.light.4.raw

SEQ ID NO: 578831 - DNA, 512 bp, Homo sapiens
  misc_feature: HIJSMM301D41ZE.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttccccg

SEQ ID NO: 578832 - DNA, 454 bp, Homo sapiens; identical to SEQ ID NO: 534964
  misc_feature: HIJSMM301EEAKL.19.86.H09.1.454.light.4.raw

SEQ ID NO: 578833 - DNA, 498 bp, Homo sapiens
  misc_feature: HIJSMM301AQBYJ.43.53.E09.1.454.light.4.raw
tgtgagtagtcacgaccggtgctcgatttagagagagtgtgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttttgccgggtcgagtcggcccattgacgactgtttggcctggtatcgcgtgagaccagggcaacctcctcaacttctgatataaccgttcatcgctgttgcacgttggggtcccacctcggttcagtggcaacggctctgagacagatttttctcttcgtcatcactggtctacagtctgacgacggcgcaatgtacttctgtcaacactatgcctctcccccctacaactttcggtcaggggaccaagttgaacatcaatcgaactgtaggctgcaccatctgtctt

SEQ ID NO: 578834 - DNA, 494 bp, Homo sapiens; identical to SEQ ID NO: 559643
  misc_feature: HIJSMM301EODNL.27.78.H01.1.454.light.4.raw

SEQ ID NO: 578835 - DNA, 542 bp, Homo sapiens
  misc_feature: HIJSMM301A9EIU.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctcgaccactctctgggctccaggctgaagacgaggctgattattactgcagctcatatacaggcagcagcacctcacggtttttcggtcgggaggggaccaaacggcttcgaaccggttcccttaacggggttccaacggcccccgaaaacgggccttcggcccccccgttccgggtt

SEQ ID NO: 578836 - DNA, 506 bp, Homo sapiens; identical to SEQ ID NO: 544450
  misc_feature: HIJSMM301DRX0U.11.75.G09.1.454.light.4.raw

SEQ ID NO: 578837 - DNA, 494 bp, Homo sapiens; identical to SEQ ID NO: 534994
  misc_feature: HIJSMM301DJB8C.27.78.H01.1.454.light.4.raw

SEQ ID NO: 578838 - DNA, 501 bp, Homo sapiens
  misc_feature: HIJSMM301A4HL7.53.62.F07.1.454.light.4.raw
cgcgtatacacacgaccggtgctcgatttagtagtcgcataaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgtcactctcg

SEQ ID NO: 578839 - DNA, 494 bp, Homo sapiens; identical to SEQ ID NO: 539894
  misc_feature: HIJSMM301C312Y.16.53.E09.1.454.light.4.raw

SEQ ID NO: 578840 - DNA, 434 bp, Homo sapiens
  misc_feature: HIJSMM301D3A12.10.38.D05.1.454.light.4.raw
catagtagtgcacgaccggtgctcgatttagtatctgatagttgggtttggggggtgtggtggtctccactccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgtttccaccctcctccactactatg

SEQ ID NO: 578841 - DNA, 497 bp, Homo sapiens; identical to SEQ ID NO: 536807
  misc_feature: HIJSMM301BGWR9.10.37.D04.1.454.light.4.raw

SEQ ID NO: 578842 - DNA, 486 bp, Homo sapiens
  misc_feature: HIJSMM301BIU25.3.59.F04.1.454.light.4.raw
agacgcactccacgaccggtgctcgatttagtacacacacttagggattggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacaccgacttggattggtttcaacagaggccaggccaatctccaaggcgcctaatttataaggtttctaagcgcgactctggggtcccagacagattcagcggcagtgggtcaggcactgacttcacactggaaatcagcagggtggaggctgaggatgttgcggtttattactgcatgcaatatacacataggcctcacacctttggccaggggaccaagctggagatcaaacgaa

SEQ ID NO: 578843 - DNA, 508 bp, Homo sapiens
  misc_feature: HIJSMM301EI8J9.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccatc

SEQ ID NO: 578844 - DNA, 512 bp, Homo sapiens; identical to SEQ ID NO: 552536
  misc_feature: HIJSMM301D6MR0.17.33.C11.1.454.light.4.raw

SEQ ID NO: 578845 - DNA, 507 bp, Homo sapiens; identical to SEQ ID NO: 564208
  misc_feature: HIJSMM301DLSWG.5.24.C02.1.454.light.4.raw

SEQ ID NO: 578846 - DNA, 494 bp, Homo sapiens
  misc_feature: HIJSMM301EBDHK.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccacctgggcatcgccggactccagactggggacgaggccgattttactgcggaacatgggataccagcctgcatggtgtggttttcggcggaggaccaagctgaccgtcctaagtcagcccaaggct

SEQ ID NO: 578847 - DNA, 377 bp, Homo sapiens; identical to SEQ ID NO: 536071
  misc_feature: HIJSMM301CCSJA.40.9.A09.1.454.light.4.raw

SEQ ID NO: 578848 - DNA, 440 bp, Homo sapiens
  misc_feature: HIJSMM301C60LN.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctctcgtatctctcg

SEQ ID NO: 578849 - DNA, 477 bp, Homo sapiens; identical to SEQ ID NO: 542993
  misc_feature: HIJSMM301D1U0X.49.27.C05.1.454.light.4.raw

SEQ ID NO: 578850 - DNA, 504 bp, Homo sapiens
  misc_feature: HIJSMM301C3KIQ.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactaactttacctcaagtgatcaccttcggccaagggacacgactggagattaaacg

SEQ ID NO: 578851 - DNA, 496 bp, Homo sapiens
  misc_feature: HIJSMM301DLJ29.26.78.H01.1.454.light.4.raw
  modified_base (466)..(466): a, c, t, g, unknown or other
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatnacgaacggaaactgtggctgcaccatctgt

SEQ ID NO: 578852 - DNA, 518 bp, Homo sapiens
  misc_feature: HIJSMM301CASLY.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccgaaggtggcaatcaaccgaactgtggctgcaccatctgtcttcatcttccccg

SEQ ID NO: 578853 - DNA, 493 bp, Homo sapiens
  misc_feature: HIJSMM301CBG6I.11.59.F04.1.454.light.4.raw
  modified_base (442)..(442): a, c, t, g, unknown or other
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattatgctgctcatatggaagtacctactcttttcncttcggaactgggaccacggtcaccgtcctaggtcagcccaaggccaaccc

SEQ ID NO: 578854 - DNA, 488 bp, Homo sapiens
  misc_feature: HIJSMM301CIOVZ.48.87.H10.1.454.light.4.raw
agtatacatacacgaccggtgctcgatttagcagtactgcgttgggtttgggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcacg

SEQ ID NO: 578855 - DNA, 489 bp, Homo sapiens; identical to SEQ ID NO: 535139
  misc_feature: HIJSMM301EGSSF.14.55.E11.1.454.light.4.raw

SEQ ID NO: 578856 - DNA, 505 bp, Homo sapiens
  misc_feature: HIJSMM301A615P.48.33.C11.1.454.light.4.raw
agtatacatacacgaccggtgctcgatttagagtgagctcgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggactgcaccatctgtcttcatcttccccg

SEQ ID NO: 578857 - DNA, 509 bp, Homo sapiens
  misc_feature: HIJSMM301CS0J9.40.41.D08.1.454.light.4.raw
tctagcgactcacgaccggtgctcgatttagtcacgcgagaaaggggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaacgccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactccccatgtggtattcggcggagggaccaagctgaccgtcctaggtcagcccaaggctgtccccccg

SEQ ID NO: 578858 - DNA, 503 bp, Homo sapiens
  misc_feature: HIJSMM301CH1ZV.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttattctgtcagcagtctgaagactggccgttcactttcggcggagggaccaaggtggacctcaaacgaactgtggctgcaccatctgtcttcatcttcccgc

SEQ ID NO: 578859 - DNA, 483 bp, Homo sapiens; identical to SEQ ID NO: 564807
  misc_feature: HIJSMM301B2K8Q.12.8.A08.1.454.light.4.raw

SEQ ID NO: 578860 - DNA, 496 bp, Homo sapiens
  misc_feature: HIJSMM301AQ5RB.51.12.B01.1.454.light.4.raw
cgatcgtatacacgaccggtgctcgatttagtagtgtagattccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 578861 - DNA, 497 bp, Homo sapiens
  misc_feature: HIJSMM301AW3LA.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgtcactctcg

SEQ ID NO: 578862 - DNA, 383 bp, Homo sapiens
  misc_feature: HIJSMM301BC0QN.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatttgaatagtataga

SEQ ID NO: 578863 - DNA, 493 bp, Homo sapiens
  misc_feature: HIJSMM301C7OEF.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggttgcaccatctgtctt

SEQ ID NO: 578864 - DNA, 467 bp, Homo sapiens
  misc_feature: HIJSMM301EMBV3.49.37.D04.1.454.light.4.raw
agtcgagagacacgaccggtgctcgatttagtagcatactgttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtgggtcccatcaaggttcagtggcagtggatctgggacagatttcaccctcaccatcagcagtctgcaacctgatgattttgcaacttattattgtcaacagagttacagtatcccgtacacttttggccagggaccaggctggatatcagacgaa

SEQ ID NO: 578865 - DNA, 340 bp, Homo sapiens
  misc_feature: HIJSMM301AIJSH.48.22.B11.1.454.light.4.raw
agtatacatacacgaccggtgctcgatttagacgacagctcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcctagtagtaaccctccgtacacttttggccaggggaccaaggtggagatcaaacgaactgtggctgcaccatctgtcttcatcttcccgccatctgatatgtatact

SEQ ID NO: 578866 - DNA, 486 bp, Homo sapiens; identical to SEQ ID NO: 535043
  misc_feature: HIJSMM301EI9XA.46.35.D02.1.454.light.4.raw

SEQ ID NO: 578867 - DNA, 486 bp, Homo sapiens; identical to SEQ ID NO: 546042
  misc_feature: HIJSMM301BZ1Q6.14.53.E09.1.454.light.4.raw

SEQ ID NO: 578868 - DNA, 510 bp, Homo sapiens
  misc_feature: HIJSMM301AH96O.41.4.A04.1.454.light.4.raw
tctatactatcacgaccggtgctcgatttagagtagtgatcaggggagagaagagctgctcagttaggacccagagggaaccatggaaaccccagcgcagcttctcttcctcctgctactctggctcccagaagccaccggagaagttgtgttgacgcagtctccggacaccctttctttgtctccaggacaaagagccaccctctcttgtagggccagtgagagtatttccggcaccttcttagcgtggtaccaacagcgacctggccaggctcccaggctcctcttctctgctgcgtatgccagggccgctggcatccctgacaggttcagtggcagtgggtctgggacagacttcactctcaccatcaatagactggagcctgaagattttgcaacatattactgtcaccagtttgcaatctcaccccaggacgttcggccaacgggaccgaacggtggaaatacaagacgaactagtggctgcaccatctgtcttcatcttcccgt

SEQ ID NO: 578869 - DNA, 497 bp, Homo sapiens
  misc_feature: HIJSMM301CVM2O.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtctaggtcagcccaaggccaaccc

SEQ ID NO: 578870 - DNA, 494 bp, Homo sapiens; identical to SEQ ID NO: 535478
  misc_feature: HIJSMM301EBNQC.10.79.H02.1.454.light.4.raw

SEQ ID NO: 578871 - DNA, 493 bp, Homo sapiens
  misc_feature: HIJSMM301COQ8T.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatggttggggtttattactgcatgcaaggtttataccttcctcggtactttcgcccgtcggaccgacgagtggagtgtacaacgaactagt

SEQ ID NO: 578872 - DNA, 478 bp, Homo sapiens; identical to SEQ ID NO: 535129
  misc_feature: HIJSMM301DFVCZ.11.11.A11.1.454.light.4.raw

SEQ ID NO: 578873 - DNA, 485 bp, Homo sapiens; identical to SEQ ID NO: 541838
  misc_feature: HIJSMM301B7G1O.22.6.A06.1.454.light.4.raw

SEQ ID NO: 578874 - DNA, 489 bp, Homo sapiens; identical to SEQ ID NO: 543840
  misc_feature: HIJSMM301A1IQI.12.88.H11.1.454.light.4.raw

SEQ ID NO: 578875 - DNA, 494 bp, Homo sapiens; identical to SEQ ID NO: 534994
  misc_feature: HIJSMM301EZ7WP.27.78.H01.1.454.light.4.raw

SEQ ID NO: 578876 - DNA, 466 bp, Homo sapiens
  misc_feature: HIJSMM301ADQWT.48.2.A02.1.454.light.4.raw
  modified_base (437)..(437): a, c, t, g, unknown or other
agtatacatacacgaccggtgctcgatttagactcatctacagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattacctcggacgtgtccngggacgaaacgtagatagtctaacgaacc

SEQ ID NO: 578877 - DNA, 502 bp, Homo sapiens
  misc_feature: HIJSMM301AJNB7.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaagctgaccgtcctaggtcagcccaaggctgccccctcggtcactctgttccccg

SEQ ID NO: 578878 - DNA, 505 bp, Homo sapiens; identical to SEQ ID NO: 574205
  misc_feature: HIJSMM301EAQX9.10.88.H11.1.454.light.4.raw

SEQ ID NO: 578879 - DNA, 508 bp, Homo sapiens; identical to SEQ ID NO: 536388
  misc_feature: HIJSMM301DNSRN.11.57.F02.1.454.light.4.raw

SEQ ID NO: 578880 - DNA, 473 bp, Homo sapiens
  misc_feature: HIJSMM301BEMTB.43.28.C06.1.454.light.4.raw
tgtgagtagtcacgaccggtgctcgatttagagctcacgtattgggtttgggggctttccctggctcctgctgctctggctcccaggtgccaaatgtgacatccagatgacccagtctccttccaccctgtctgcatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatcaaacgaactagtggctgcaccatctgtcttcatcttcccgccatctgaactactcaca

SEQ ID NO: 578881 - DNA, 495 bp, Homo sapiens
  misc_feature: HIJSMM301A1D9V.4.23.C01.1.454.light.4.raw
agcactgtagcacgaccggtgctcgatttagtacacgtgattagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttatattgtcaccagtattatagttggcctccgtggacgttggccaagggaccaaggtggaaatcaaacgaactagtggctgcaccatctgtctt

SEQ ID NO: 578882 - DNA, 490 bp, Homo sapiens; identical to SEQ ID NO: 543909
  misc_feature: HIJSMM301BSHLB.14.55.E11.1.454.light.4.raw

SEQ ID NO: 578883 - DNA, 488 bp, Homo sapiens; identical to SEQ ID NO: 537527
  misc_feature: HIJSMM301CMX25.26.78.H01.1.454.light.4.raw

SEQ ID NO: 578884 - DNA, 516 bp, Homo sapiens; identical to SEQ ID NO: 547638
  misc_feature: HIJSMM301AE4B1.47.53.E09.1.454.light.4.raw

SEQ ID NO: 578885 - DNA, 486 bp, Homo sapiens; identical to SEQ ID NO: 535043
  misc_feature: HIJSMM301D2WBB.46.35.D02.1.454.light.4.raw

SEQ ID NO: 578886 - DNA, 470 bp, Homo sapiens
  misc_feature: HIJSMM301AQGA6.41.48.E04.1.454.light.4.raw
tctatactatcacgaccggtgctcgatttagagagcgtcacagagagaaggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtgggttttcggtcggagggacccaagctgaccgtcct

SEQ ID NO: 578887 - DNA, 510 bp, Homo sapiens; identical to SEQ ID NO: 542037
  misc_feature: HIJSMM301AUBM8.4.57.F02.1.454.light.4.raw

SEQ ID NO: 578888 - DNA, 484 bp, Homo sapiens; identical to SEQ ID NO: 535400
  misc_feature: HIJSMM301DNNWN.46.26.C04.1.454.light.4.raw

SEQ ID NO: 578889 - DNA, 494 bp, Homo sapiens; identical to SEQ ID NO: 534992
  misc_feature: HIJSMM301D5WWN.9.1.A01.1.454.light.4.raw

SEQ ID NO: 578890 - DNA, 513 bp, Homo sapiens
  misc_feature: HIJSMM301BCF9F.22.46.E02.1.454.light.4.raw
  modified_base (322)..(322): a, c, t, g, unknown or other
acatacgcgtcacgaccggtgctcgatttagactcatctacagggaaaggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaacgccccccaactcttaatttttggtgtcaataaccgcccctnaggggtccctgatcgcttctccggctccaagtctggcaacacggcctccctgaccatctctggactccaggctgacgatgagggtgacttttactgctgctcatatgcaggcaactataatatggtcttcggcggagggaccaaaagtgaccgtcctaggtcagcccaaggctcgccccctccggtcactt

SEQ ID NO: 578891 - DNA, 512 bp, Homo sapiens
  misc_feature: HIJSMM301ET4SD.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtcggaaatcaaacgaaactgtggctgcaccatctgtcttt

SEQ ID NO: 578892 - DNA, 445 bp, Homo sapiens; identical to SEQ ID NO: 537719
  misc_feature: HIJSMM301BZ83S.47.85.H08.1.454.light.4.raw

SEQ ID NO: 578893 - DNA, 494 bp, Homo sapiens; identical to SEQ ID NO: 535276
  misc_feature: HIJSMM301DGN04.16.6.A06.1.454.light.4.raw

SEQ ID NO: 578894 - DNA, 487 bp, Homo sapiens
  misc_feature: HIJSMM301CUSNN.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccagggaccaggtggaagtcgaagcgaactgtggctgcaccatctgt

SEQ ID NO: 578895 - DNA, 487 bp, Homo sapiens; identical to SEQ ID NO: 536536
  misc_feature: HIJSMM301BQU8A.26.45.E01.1.454.light.4.raw

SEQ ID NO: 578896 - DNA, 495 bp, Homo sapiens; identical to SEQ ID NO: 535007
  misc_feature: HIJSMM301BWVMI.22.5.A05.1.454.light.4.raw

SEQ ID NO: 578897 - DNA, 487 bp, Homo sapiens
  misc_feature: HIJSMM301DI61D.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccagtcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 578898 - DNA, 479 bp, Homo sapiens; identical to SEQ ID NO: 539141
  misc_feature: HIJSMM301ETS2V.7.67.G01.1.454.light.4.raw

SEQ ID NO: 578899 - DNA, 504 bp, Homo sapiens; identical to SEQ ID NO: 538940
  misc_feature: HIJSMM301A7PXM.2.35.D02.1.454.light.4.raw

SEQ ID NO: 578900 - DNA, 502 bp, Homo sapiens
  misc_feature: HIJSMM301DTR2N.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaaacgaactgtggctgcaccatctgtcttcatt

SEQ ID NO: 578901 - DNA, 493 bp, Homo sapiens; identical to SEQ ID NO: 536471
  misc_feature: HIJSMM301ETXII.3.71.G05.1.454.light.4.raw

SEQ ID NO: 578902 - DNA, 518 bp, Homo sapiens
  misc_feature: HIJSMM301BYKIP.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccgccctcctccgt

SEQ ID NO: 578903 - DNA, 495 bp, Homo sapiens; identical to SEQ ID NO: 538920
  misc_feature: HIJSMM301EY8LM.47.64.F09.1.454.light.4.raw

SEQ ID NO: 578904 - DNA, 501 bp, Homo sapiens
  misc_feature: HIJSMM301CYS2P.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgccccctcggtccactcctcgttcccaccctccctcgagtgcgtct

SEQ ID NO: 578905 - DNA, 472 bp, Homo sapiens; identical to SEQ ID NO: 535898
  misc_feature: HIJSMM301BPOL0.15.8.A08.1.454.light.4.raw

SEQ ID NO: 578906 - DNA, 486 bp, Homo sapiens
  misc_feature: HIJSMM301BQ9IV.5.23.C01.1.454.light.4.raw
atcagacacgcacgaccggtgctcgatttagtacacgtgattagggattgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgctaacttactactgtcaacagagttacgatacccctccgctcactttcggcggaggaccaaggtggagatacaacgaactgtggctgcacat

SEQ ID NO: 578907 - DNA, 509 bp, Homo sapiens
  misc_feature: HIJSMM301BRGEB.41.30.C08.1.454.light.4.raw
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaaccccactgtcact

SEQ ID NO: 578908 - DNA, 486 bp, Homo sapiens; identical to SEQ ID NO: 535043
  misc_feature: HIJSMM301AR3HG.46.35.D02.1.454.light.4.raw

SEQ ID NO: 578909 - DNA, 507 bp, Homo sapiens
  misc_feature: HIJSMM301B7T2L.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaaactggtgcgtgcaccatctgtcttctatcttccccg

SEQ ID NO: 578910 - DNA, 487 bp, Homo sapiens; identical to SEQ ID NO: 544897
  misc_feature: HIJSMM301CJFQ9.46.35.D02.1.454.light.4.raw

SEQ ID NO: 578911 - DNA, 495 bp, Homo sapiens; identical to SEQ ID NO: 535596
  misc_feature: HIJSMM301AEF2M.10.79.H02.1.454.light.4.raw

SEQ ID NO: 578912 - DNA, 483 bp, Homo sapiens
  misc_feature: HIJSMM301DPQ7K.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgtagtctgaagatttgcggtttattactgtcagcagtatgataactggctgtacacttttggccagggaccaagctggagatcaggcgaactgtggctgcacca

SEQ ID NO: 578913 - DNA, 486 bp, Homo sapiens; identical to SEQ ID NO: 535385
  misc_feature: HIJSMM301C1AJM.19.71.G05.1.454.light.4.raw

SEQ ID NO: 578914 - DNA, 498 bp, Homo sapiens; identical to SEQ ID NO: 577302
  misc_feature: HIJSMM301DF4ER.16.12.B01.1.454.light.4.raw

SEQ ID NO: 578915 - DNA, 490 bp, Homo sapiens
  misc_feature: HIJSMM301AXQ16.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccactgtcactctgttcccaccctcctctacgtgagct

SEQ ID NO: 578916 - DNA, 449 bp, Homo sapiens
  misc_feature: HIJSMM301AI5RK.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtccctatgacatgaggctgagtggttcgtatgtcttcggatctgggaccaaggtcaccgtcctaagtcagcccaaggcccaacccctctgtcactctgttcccgccctcctccatactcgta

SEQ ID NO: 578917 - DNA, 454 bp, Homo sapiens; identical to SEQ ID NO: 536943
  misc_feature: HIJSMM301DFV0A.19.86.H09.1.454.light.4.raw

SEQ ID NO: 578918 - DNA, 509 bp, Homo sapiens
  misc_feature: HIJSMM301A0MNT.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagcccccgaacctcctgatctacggtacatccactttgcacagtgggatcccatcaaggttcagtggcagtagatctggaacagattttaccctcaccatcaggggtctacagcctgaagattttgcgactttactattgtcaacagagtttaccttctccccccggagttcgccgaggaccgaaggtggaagtacagacgaactagtggcgtgcaccatctgtctttccatctttcccg

SEQ ID NO: 578919 - DNA, 511 bp, Homo sapiens; identical to SEQ ID NO: 548439
  misc_feature: HIJSMM301CMX2S.16.46.E02.1.454.light.4.raw

SEQ ID NO: 578920 - DNA, 502 bp, Homo sapiens; identical to SEQ ID NO: 543913
  misc_feature: HIJSMM301A58F7.18.26.C04.1.454.light.4.raw

SEQ ID NO: 578921 - DNA, 504 bp, Homo sapiens; identical to SEQ ID NO: 550923
  misc_feature: HIJSMM301DT5LR.51.2.A02.1.454.light.4.raw

SEQ ID NO: 578922 - DNA, 486 bp, Homo sapiens; identical to SEQ ID NO: 535043
  misc_feature: HIJSMM301D0IZ2.46.35.D02.1.454.light.4.raw

SEQ ID NO: 578923 - DNA, 495 bp, Homo sapiens; identical to SEQ ID NO: 536359
  misc_feature: HIJSMM301BAZ4W.48.4.A04.1.454.light.4.raw

SEQ ID NO: 578924 - DNA, 486 bp, Homo sapiens; identical to SEQ ID NO: 537840
  misc_feature: HIJSMM301D27ZM.40.81.H04.1.454.light.4.raw

SEQ ID NO: 578925 - DNA, 521 bp, Homo sapiens; identical to SEQ ID NO: 538715
  misc_feature: HIJSMM301A99CS.27.23.C01.1.454.light.4.raw

SEQ ID NO: 578926 - DNA, 509 bp, Homo sapiens
  misc_feature: HIJSMM301A6POH.4.57.F02.1.454.light.4.raw
agcactgtagcacgaccggtgctcgatttagctcgatatagttggggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggacaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttcccg

SEQ ID NO: 578927 - DNA, 471 bp, Homo sapiens; identical to SEQ ID NO: 539388
  misc_feature: HIJSMM301BSFVP.13.39.D06.1.454.light.4.raw

SEQ ID NO: 578928 - DNA, 486 bp, Homo sapiens; identical to SEQ ID NO: 535043
  misc_feature: HIJSMM301DN8FV.46.35.D02.1.454.light.4.raw

SEQ ID NO: 578929 - DNA, 484 bp, Homo sapiens
  misc_feature: HIJSMM301D5WGF.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtcctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 578930 - DNA, 496 bp, Homo sapiens
  misc_feature: HIJSMM301A9JNI.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagttattactgtcagcagtataataactggcctcggacgttcggccaagggaccaaggtggaagtcgaaacgaactagtggctgcaccatctgtcttcatcttcccgt

SEQ ID NO: 578931 - DNA, 486 bp, Homo sapiens; identical to SEQ ID NO: 548936
  misc_feature: HIJSMM301EB46K.5.55.E11.1.454.light.4.raw

SEQ ID NO: 578932 - DNA, 502 bp, Homo sapiens; identical to SEQ ID NO: 541971
  misc_feature: HIJSMM301BJCV4.4.39.D06.1.454.light.4.raw

SEQ ID NO: 578933 - DNA, 499 bp, Homo sapiens
  misc_feature: HIJSMM301BPT7I.11.67.G01.1.454.light.4.raw
cgagagataccacgaccggtgctcgatttagagtatacatattgggtttgggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaac

SEQ ID NO: 578934 - DNA, 485 bp, Homo sapiens; identical to SEQ ID NO: 535606
  misc_feature: HIJSMM301ECDJL.47.46.E02.1.454.light.4.raw

SEQ ID NO: 578935 - DNA, 441 bp, Homo sapiens
  misc_feature: HIJSMM301B02AB.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggcccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccctcctcattagtataga

SEQ ID NO: 578936 - DNA, 500 bp, Homo sapiens; identical to SEQ ID NO: 541872
  misc_feature: HIJSMM301EKGZF.48.82.H05.1.454.light.4.raw

SEQ ID NO: 578937 - DNA, 484 bp, Homo sapiens; identical to SEQ ID NO: 536162
  misc_feature: HIJSMM301B8FPF.13.59.F04.1.454.light.4.raw

SEQ ID NO: 578938 - DNA, 444 bp, Homo sapiens; identical to SEQ ID NO: 544240
  misc_feature: HIJSMM301EB6WB.9.9.A09.1.454.light.4.raw
  modified_base (426)..(426): a, c, t, g, unknown or other

SEQ ID NO: 578939 - DNA, 383 bp, Homo sapiens; identical to SEQ ID NO: 447524
  misc_feature: HIJSMM301EYH2E.41.26.C04.1.454.light.4.raw

SEQ ID NO: 578940 - DNA, 460 bp, Homo sapiens
  misc_feature: HIJSMM301D7S4G.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaagctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 578941 - DNA, 498 bp, Homo sapiens
  misc_feature: HIJSMM301D4S1G.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccgagggtggaaagtacaaacgaactagtggctgcacactctgtcttcat

SEQ ID NO: 578942 - DNA, 482 bp, Homo sapiens
  misc_feature: HIJSMM301B8I75.41.17.B06.1.454.light.4.raw
tctatactatcacgaccggtgctcgatttagtcgatagtgaagggggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcacc

SEQ ID NO: 578943 - DNA, 494 bp, Homo sapiens; identical to SEQ ID NO: 539894
  misc_feature: HIJSMM301CTIYL.16.53.E09.1.454.light.4.raw

SEQ ID NO: 578944 - DNA, 467 bp, Homo sapiens; identical to SEQ ID NO: 538403
  misc_feature: HIJSMM301DPYX4.41.48.E04.1.454.light.4.raw

SEQ ID NO: 578945 - DNA, 499 bp, Homo sapiens; identical to SEQ ID NO: 557417
  misc_feature: HIJSMM301B7HC2.12.26.C04.1.454.light.4.raw

SEQ ID NO: 578946 - DNA, 473 bp, Homo sapiens
  misc_feature: HIJSMM301CQOTN.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccaaggtggagatcaagcgaactgtggc

SEQ ID NO: 578947 - DNA, 500 bp, Homo sapiens
  misc_feature: HIJSMM301AL3JE.14.36.D03.1.454.light.4.raw
cgtctagtaccacgaccggtgctcgatttagctgcgtcacgatctctcttggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatcgtggttttcgggtcggggggaccaagggtgaccgtcctaggtcagcccaagg

SEQ ID NO: 578948 - DNA, 499 bp, Homo sapiens
  misc_feature: HIJSMM301C35YX.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcaggggacccaggccttggatgaggctgactatcactgtcaggcgtgggacagcaacactgcgattttcggcgggggaccagggctgaccgtcggcggtcagcccaaggctgccccctcggtcactctgttcccg

SEQ ID NO: 578949 - DNA, 506 bp, Homo sapiens
  misc_feature: HIJSMM301A0O6J.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattacttgcagctcatatgcaggcagcagcagtccccatgtgatcttcggcggggggaccaagctgaccgtcctaggtcagcccaggctgcccccg

SEQ ID NO: 578950 - DNA, 493 bp, Homo sapiens; identical to SEQ ID NO: 544835
  misc_feature: HIJSMM301DU565.43.29.C07.1.454.light.4.raw

SEQ ID NO: 578951 - DNA, 516 bp, Homo sapiens; identical to SEQ ID NO: 552129
  misc_feature: HIJSMM301D2W3I.27.23.C01.1.454.light.4.raw

SEQ ID NO: 578952 - DNA, 483 bp, Homo sapiens
  misc_feature: HIJSMM301AL562.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcgcggaggaccaaggtggagatcaaacgaactgtggctgcacc

SEQ ID NO: 578953 - DNA, 444 bp, Homo sapiens; identical to SEQ ID NO: 535856
  misc_feature: HIJSMM301AV52C.9.9.A09.1.454.light.4.raw

SEQ ID NO: 578954 - DNA, 490 bp, Homo sapiens
  misc_feature: HIJSMM301DHJIY.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagatttagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatctgt

SEQ ID NO: 578955 - DNA, 503 bp, Homo sapiens
  misc_feature: HIJSMM301DAXRA.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctcctgaccgtctctgggctccaggctgaagatgaggctgattattactgctgctcatatgcaggccgcaacagtgatctattcggcggagggaccaagctgaccgtcctaggtcagcccaaggctcgccccctc

SEQ ID NO: 578956 - DNA, 497 bp, Homo sapiens
  misc_feature: HIJSMM301DVNZ4.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggatatcagacgaactgtggctgca

SEQ ID NO: 578957 - DNA, 444 bp, Homo sapiens; identical to SEQ ID NO: 535411
  misc_feature: HIJSMM301B488C.8.73.G07.1.454.light.4.raw

SEQ ID NO: 578958 - DNA, 354 bp, Homo sapiens; identical to SEQ ID NO: 535026
  misc_feature: HIJSMM301A194Q.19.22.B11.1.454.light.4.raw

SEQ ID NO: 578959 - DNA, 505 bp, Homo sapiens
  misc_feature: HIJSMM301CDZ6X.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcacgtcctaggtcagcccaaggccaacccactgtcact

SEQ ID NO: 578960 - DNA, 544 bp, Homo sapiens
  misc_feature: HIJSMM301BKEOW.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttcttgtcagcagtctgaagaactggccggttctacttcggtcggacgggacggaacggtagggtaccggtacctaaaccgaaaccgtaacgtggtcgtcgtcacccactcctgttcttctactcttcccgtccctacct

SEQ ID NO: 578961 - DNA, 491 bp, Homo sapiens
  misc_feature: HIJSMM301C6GT2.10.59.F04.1.454.light.4.raw
catagtagtgcacgaccggtgctcgatttagtacacacacttagggattggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtcctaggtcagaccccg

SEQ ID NO: 578962 - DNA, 494 bp, Homo sapiens
  misc_feature: HIJSMM301BTCI7.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctaacaggttcagtggcagtggatcaggcacagattttacactgaaaatcaacagagtggaggctgaggatgttggggtttattactgcatgcaagctctacaaactccctcaacgttcggcggagggaccaaggtggagatcaaacgaactgtggctgcaccatctgtcttcatt

SEQ ID NO: 578963 - DNA, 472 bp, Homo sapiens; identical to SEQ ID NO: 547803
  misc_feature: HIJSMM301AOAQ6.5.34.D01.1.454.light.4.raw

SEQ ID NO: 578964 - DNA, 478 bp, Homo sapiens; identical to SEQ ID NO: 535129
  misc_feature: HIJSMM301DQ0Q8.11.11.A11.1.454.light.4.raw

SEQ ID NO: 578965 - DNA, 514 bp, Homo sapiens
  misc_feature: HIJSMM301EM8VD.40.57.F02.1.454.light.4.raw
  modified_base (503)..(503): a, c, t, g, unknown or other
tctagcgactcacgaccggtgctcgatttagctcgatatagttgggtttggggtgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttcgtctggagtgccagataggttcagtggcgagcgggtcgagtgacagaatttctacactgaaaatacagccgggtcgggaggcgtgaggagtgttggggtttagtttacttgcatgcaaggtttagttaaccttccttccggtacttcggtcccgtcgggtaccgacgaagtggagtgtntaacgaaacta

SEQ ID NO: 578966 - DNA, 498 bp, Homo sapiens
  misc_feature: HIJSMM301ET53X.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccttggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatctgaca

SEQ ID NO: 578967 - DNA, 496 bp, Homo sapiens; identical to SEQ ID NO: 553382
  misc_feature: HIJSMM301AIC6A.51.59.F04.1.454.light.4.raw

SEQ ID NO: 578968 - DNA, 454 bp, Homo sapiens; identical to SEQ ID NO: 536347
  misc_feature: HIJSMM301EDC4S.19.86.H09.1.454.light.4.raw

SEQ ID NO: 578969 - DNA, 440 bp, Homo sapiens; identical to SEQ ID NO: 570321
  misc_feature: HIJSMM301B7EFY.17.11.A11.1.454.light.4.raw

SEQ ID NO: 578970 - DNA, 471 bp, Homo sapiens
  misc_feature: HIJSMM301BIFLA.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcgctgagggaccaaggtggagatcaaacgaactgtggctgcaccat

SEQ ID NO: 578971 - DNA, 497 bp, Homo sapiens; identical to SEQ ID NO: 535286
  misc_feature: HIJSMM301CNNEE.18.59.F04.1.454.light.4.raw

SEQ ID NO: 578972 - DNA, 493 bp, Homo sapiens; identical to SEQ ID NO: 535084
  misc_feature: HIJSMM301EV5FY.47.64.F09.1.454.light.4.raw

SEQ ID NO: 578973 - DNA, 504 bp, Homo sapiens; identical to SEQ ID NO: 538940
  misc_feature: HIJSMM301ESN6A.2.35.D02.1.454.light.4.raw

SEQ ID NO: 578974 - DNA, 502 bp, Homo sapiens
  misc_feature: HIJSMM301DC9V6.2.76.G10.1.454.light.4.raw
  modified_base (461)..(461): a, c, t, g, unknown or other
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggacctgggaccaaggtcaccgtccttggt

SEQ ID NO: 578975 - DNA, 494 bp, Homo sapiens; identical to SEQ ID NO: 548501
  misc_feature: HIJSMM301EHIY4.52.54.E10.1.454.light.4.raw

SEQ ID NO: 578976 - DNA, 480 bp, Homo sapiens; identical to SEQ ID NO: 535442
  misc_feature: HIJSMM301CAKZ8.41.17.B06.1.454.light.4.raw

SEQ ID NO: 578977 - DNA, 491 bp, Homo sapiens
  misc_feature: HIJSMM301AI2UU.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcggccgaggaccaagtaggacatcaagacgaactagtggctgcaccatctgtt

SEQ ID NO: 578978 - DNA, 483 bp, Homo sapiens
  misc_feature: HIJSMM301BB67A.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 578979 - DNA, 487 bp, Homo sapiens
  misc_feature: HIJSMM301AE5Z2.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggacttcgtccgtcggaccgacgagtggagtgtcgaacgaact

SEQ ID NO: 578980 - DNA, 491 bp, Homo sapiens
  misc_feature: HIJSMM301D9VDW.4.71.G05.1.454.light.4.raw
agcactgtagcacgaccggtgctcgatttagtgtcgtcgcaagagagaggggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgtttattcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttattactgtcagcagtattatataactcccttcactttcggcggagggaccaaggtggagatcaaacgaactgtgg

SEQ ID NO: 578981 - DNA, 503 bp, Homo sapiens
  misc_feature: HIJSMM301BPAYE.51.69.G03.1.454.light.4.raw
  modified_base (460)..(460): a, c, t, g, unknown or other
  modified_base (489)..(489): a, c, t, g, unknown or other
cgatcgtatacacgaccggtgctcgatttagtcgctgcgtaaaggagaaagggggcttcagctgtgggcacaagaggcagcactcaggacaagtctccgagacgatggacctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaccttatgatgtacactggtaccaacaacttccaggagcagcccccaaactcctcatctttggtaacaacaatcggccctcaggggtccctgaccgattctctggctccaggtctggcacctcagcctccctggccatcacgtgggctccaggctgaggatgagggtgatttattactgccagtcctatgacagcggcctcagttntttggtggtgttcggcggaggaccaggtnaccgtctaagcacg

SEQ ID NO: 578982 - DNA, 497 bp, Homo sapiens
  misc_feature: HIJSMM301BSPHN.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtctaggtcagcccaaggctcg

SEQ ID NO: 578983 - DNA, 508 bp, Homo sapiens
  misc_feature: HIJSMM301ERSCP.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctcctgaccatcagtgggctccggtccgaggatgaggctgattattactgtgcaccgtgggatgacatcctgaatggtccggtgttcggcggagggaccaggctgaccgtcctaagtcagcccaaggctgcccccc

SEQ ID NO: 578984 - DNA, 520 bp, Homo sapiens; identical to SEQ ID NO: 537173
  misc_feature: HIJSMM301EWOMU.27.23.C01.1.454.light.4.raw

SEQ ID NO: 578985 - DNA, 512 bp, Homo sapiens
  misc_feature: HIJSMM301ENCP1.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcaaaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagccaaggctgccccctcggtcactctgttccaccct

SEQ ID NO: 578986 - DNA, 502 bp, Homo sapiens; identical to SEQ ID NO: 541971
  misc_feature: HIJSMM301A5FHU.4.39.D06.1.454.light.4.raw

SEQ ID NO: 578987 - DNA, 496 bp, Homo sapiens; identical to SEQ ID NO: 541772
  misc_feature: HIJSMM301DJ8N8.51.81.H04.1.454.light.4.raw

SEQ ID NO: 578988 - DNA, 507 bp, Homo sapiens
  misc_feature: HIJSMM301BFZKB.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgacccttcgggtgcgcagcctgaggatgaggctgagtattactgcttgctctcctatagtggtgttcgggtgttcgggcggagggaccaaggctgaccgtcctaggtcagcccaaggctgccccctcggtcactctgttcccaccctcctcgctacgtaga

SEQ ID NO: 578989 - DNA, 498 bp, Homo sapiens
  misc_feature: HIJSMM301B93V1.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccc

SEQ ID NO: 578990 - DNA, 470 bp, Homo sapiens
  misc_feature: HIJSMM301CSN84.49.4.A04.1.454.light.4.raw
agtcgagagacacgaccggtgctcgatttagagtagtgatcagggggtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccaaggtggagatcaagcgaactgtggctgca

SEQ ID NO: 578991 - DNA, 447 bp, Homo sapiens; identical to SEQ ID NO: 535201
  misc_feature: HIJSMM301BXHCR.18.9.A09.1.454.light.4.raw

SEQ ID NO: 578992 - DNA, 521 bp, Homo sapiens
  misc_feature: HIJSMM301C2CWZ.40.12.B01.1.454.light.4.raw
tctagcgactcacgaccggtgctcgatttagtagtgtagattccgcggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccgaagctcgaccgtcctagggtcaggccccaaggctcgccccctcggtcactctgttccca

SEQ ID NO: 578993 - DNA, 472 bp, Homo sapiens; identical to SEQ ID NO: 536302
  misc_feature: HIJSMM301B8086.18.76.G10.1.454.light.4.raw

SEQ ID NO: 578994 - DNA, 486 bp, Homo sapiens
  misc_feature: HIJSMM301B8X0X.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactagtggctgcaccatctgtcttcta

SEQ ID NO: 578995 - DNA, 505 bp, Homo sapiens
  misc_feature: HIJSMM301C70YY.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactcctgttccccaccctcctcta

SEQ ID NO: 578996 - DNA, 508 bp, Homo sapiens
  misc_feature: HIJSMM301CYSNO.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatggggatgaacaatctgagcggttgggtgttcggcggagggaccaaactgaccgtcctaggtccagcccaa

SEQ ID NO: 578997 - DNA, 515 bp, Homo sapiens
  misc_feature: HIJSMM301CT2ON.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggcctgccccctggtcactctgttcccgccctcctcgctacgtagac

SEQ ID NO: 578998 - DNA, 497 bp, Homo sapiens; identical to SEQ ID NO: 546781
  misc_feature: HIJSMM301CPL62.43.28.C06.1.454.light.4.raw

SEQ ID NO: 578999 - DNA, 529 bp, Homo sapiens
  misc_feature: HIJSMM301CQP9G.43.35.D02.1.454.light.4.raw
tgtgagtagtcacgaccggtgctcgatttagcacacgatagttgggtttgggtctgcttcagctgtgagcgcagaaggcaggactcgggacaatcttcatcatgacctgctcccctctcctcctcacccttctcattcactgcacagggtcctgggcccagtctgtcttgacgcagccgccctcagtgtctgcggccccaggacagaaggtcaccatctcctgcactggaagtacgtccaacattgggaatttttatgtatcctggtaccaacaagtcccaggaacagcccccaaactcctcgtttatcacaatagtcagcgaccgtcagggattcctgaccgattttctggctccaagtctggcacgtcagccaccctggtcatcaccggactccagactggggacgaggccgattattactgcggaacatgggataccagtccggagggttgggtgttcgggcggaggggaccaagttgaccgtcctaggtcagcccaaggctgccccctcggtcactctgttccca

SEQ ID NO: 579000 - DNA, 496 bp, Homo sapiens; identical to SEQ ID NO: 559491
  misc_feature: HIJSMM301ENM9W.18.59.F04.1.454.light.4.raw

SEQ ID NO: 579001 - DNA, 511 bp, Homo sapiens
  misc_feature: HIJSMM301CQ02Y.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccactgtgatcttcggcggggggaccaaggctgaccgtcctaggtcagcccaaggctcgtccccccg

SEQ ID NO: 579002 - DNA, 502 bp, Homo sapiens; identical to SEQ ID NO: 539002
  misc_feature: HIJSMM301AFHHU.18.59.F04.1.454.light.4.raw

SEQ ID NO: 579003 - DNA, 495 bp, Homo sapiens
  misc_feature: HIJSMM301C8Q33.4.59.F04.1.454.light.4.raw
agcactgtagcacgaccggtgctcgatttagtacacacacttagggattggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttatattgtcaccagtattatagttggcctccgtggacgttcggccaaggaccaaggtggaaatcaaacgaactgtggctgcaccatctgtcttta

SEQ ID NO: 579004 - DNA, 482 bp, Homo sapiens
  misc_feature: HIJSMM301DQYBG.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccagggaccaggctggagatcaaacgaactgtggctgcaccatctgtt

SEQ ID NO: 579005 - DNA, 490 bp, Homo sapiens; identical to SEQ ID NO: 535526
  misc_feature: HIJSMM301CV9YW.26.78.H01.1.454.light.4.raw

SEQ ID NO: 579006 - DNA, 503 bp, Homo sapiens
  misc_feature: HIJSMM301BIE4N.5.86.H09.1.454.light.4.raw
atcagacacgcacgaccggtgctcgatttagtgctatagacgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgacccgtctctgggctccagctgaggatgaggctgactattactgcagctcatttgcaggcagccgtatactcttcggcggagggaccaagctgaccgtcctaggtcagcccaaggctgccccctggtca

SEQ ID NO: 579007 - DNA, 488 bp, Homo sapiens
  misc_feature: HIJSMM301C23LQ.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcacatctgtt

SEQ ID NO: 579008 - DNA, 491 bp, Homo sapiens; identical to SEQ ID NO: 542796
  misc_feature: HIJSMM301ALG0A.19.57.F02.1.454.light.4.raw

SEQ ID NO: 579009 - DNA, 485 bp, Homo sapiens; identical to SEQ ID NO: 576738
  misc_feature: HIJSMM301B2K09.19.71.G05.1.454.light.4.raw

SEQ ID NO: 579010 - DNA, 503 bp, Homo sapiens
  misc_feature: HIJSMM301A7RUD.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcacatctgtt

SEQ ID NO: 579011 - DNA, 487 bp, Homo sapiens; identical to SEQ ID NO: 536206
  misc_feature: HIJSMM301B59ZD.47.38.D05.1.454.light.4.raw

SEQ ID NO: 579012 - DNA, 505 bp, Homo sapiens
  misc_feature: HIJSMM301DKCA6.4.39.D06.1.454.light.4.raw
  modified_base (451)..(451): a, c, t, g, unknown or other
agcactgtagcacgaccggtgctcgatttagtgacatctcgcagttctttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgaatnttacggcggagggaccaaactgaccgtcctaggtcagcccaaggctgccccctc

SEQ ID NO: 579013 - DNA, 521 bp, Homo sapiens
  misc_feature: HIJSMM301DX8DU.19.81.H04.1.454.light.4.raw
tactctcgtgcacgaccggtgctcgatttagtagtgtagattcgcggggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttctgatacaaccaacagacattccttgacacccgcccgcttttcaggttacctccttgggggcaaagctgccctgaccctttcgggcgcgcagcctgaggatgaggcagagtacctgtgttccctcgtccactccggttttttgtgttcggcggagggaccagactgaccgtcctcggtcagcccaaggctgcccctcggtcactctgttcccgccctcctccacgagagta

SEQ ID NO: 579014 - DNA, 500 bp, Homo sapiens
  misc_feature: HIJSMM301D1H1T.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcgacggagggaccaaggtggagatcaagcgaactgtggctgcaccatctgtcttcatcttcccgccta

SEQ ID NO: 579015 - DNA, 483 bp, Homo sapiens; identical to SEQ ID NO: 555750
  misc_feature: HIJSMM301B9SZ6.41.78.H01.1.454.light.4.raw

SEQ ID NO: 579016 - DNA, 485 bp, Homo sapiens
  misc_feature: HIJSMM301ASWI2.18.76.G10.1.454.light.4.raw
tacgagtatgcacgaccggtgctcgatttagtcactcatacagggggcaggagtcagtcccaaccaggacacagcatggacatgagggtccctgctcagctccgtggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagtattttaatttcaccatcagcagcctccaacgtgatgatgttgcaacatactattgtcagcaatatgattttgctcctccgagtgccacgttttgggcggggggacccgaagggtggacatacaaacggaaactt

SEQ ID NO: 579017 - DNA, 485 bp, Homo sapiens; identical to SEQ ID NO: 545103
  misc_feature: HIJSMM301AWWY8.5.42.D09.1.454.light.4.raw

SEQ ID NO: 579018 - DNA, 503 bp, Homo sapiens; identical to SEQ ID NO: 537518
  misc_feature: HIJSMM301BO6V6.8.19.B08.1.454.light.4.raw

SEQ ID NO: 579019 - DNA, 467 bp, Homo sapiens; identical to SEQ ID NO: 547366
  misc_feature: HIJSMM301EKQRP.3.20.B09.1.454.light.4.raw

SEQ ID NO: 579020 - DNA, 493 bp, Homo sapiens
  misc_feature: HIJSMM301BXS7D.49.7.A07.1.454.light.4.raw
agtcgagagacacgaccggtgctcgatttagcacgtgtcgcagggggtggtagctcaggaagcagagcctggagcatctccactatggcctgggctccactacttctcaccctcctcgctcactgcacaggttcttgggccaatttgatgctgattcagccccactctgtgtcggagtctccggggaagacggtaaccatctcctgcaccggcagcagtggcagcattggcagcaactatgtgcagtggtaccagcagcgcccgggcagtgcccccaccaccgtgatctatggggataacgaaagaccctctggggtccctgatcgattctctggctccatcgacagctcctccaagtctgcctccctcaccatctctggactgaagactgaggacgaggctgactactattgtcagacgtatgattataacacctgggtgttcggcggagggaccaagctgaccgtcctaagtcagcccaaggctgcccccc

SEQ ID NO: 579021 - DNA, 497 bp, Homo sapiens
  misc_feature: HIJSMM301CQR6Z.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgtggtccaagggaccaaggtggaaatacaaacgaactagtgcgtgcacca

SEQ ID NO: 579022 - DNA, 485 bp, Homo sapiens
  misc_feature: HIJSMM301CTFW1.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaacttcggccaggggacacgactggagattaaacgaactgtggctgcaccatctgtt

SEQ ID NO: 579023 - DNA, 478 bp, Homo sapiens
  misc_feature: HIJSMM301C0EMP.49.8.A08.1.454.light.4.raw
agtcgagagacacgaccggtgctcgatttagcatactctacagggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcgagggaccaaggtggagatcaaacgaactgtggctgcacc

SEQ ID NO: 579024 - DNA, 488 bp, Homo sapiens; identical to SEQ ID NO: 559278
  misc_feature: HIJSMM301ETCE6.26.45.E01.1.454.light.4.raw

SEQ ID NO: 579025 - DNA, 503 bp, Homo sapiens
  misc_feature: HIJSMM301BSQKC.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgttctttcggaacttgggaccgaggtcaccgtcctaggtcagcccaaggccaacccca

SEQ ID NO: 579026 - DNA, 489 bp, Homo sapiens; identical to SEQ ID NO: 535386
  misc_feature: HIJSMM301BXGD7.12.51.E07.1.454.light.4.raw

SEQ ID NO: 579027 - DNA, 515 bp, Homo sapiens
  misc_feature: HIJSMM301BX6HT.47.85.H08.1.454.light.4.raw
agctcacgtacacgaccggtgctcgatttagtatcactcagtcggcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttccccg

SEQ ID NO: 579028 - DNA, 484 bp, Homo sapiens
  misc_feature: HIJSMM301AS5ZV.48.37.D04.1.454.light.4.raw
agtatacatacacgaccggtgctcgatttagtagcatactgttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacgatcagcagtgaggtggttttcggtcggagggaccgaagctgaccgtcctaacgtcagaccccg

SEQ ID NO: 579029 - DNA, 493 bp, Homo sapiens; identical to SEQ ID NO: 536769
  misc_feature: HIJSMM301CGZ97.19.83.H06.1.454.light.4.raw

SEQ ID NO: 579030 - DNA, 494 bp, Homo sapiens; identical to SEQ ID NO: 534994
  misc_feature: HIJSMM301DQ4EH.27.78.H01.1.454.light.4.raw

SEQ ID NO: 579031 - DNA, 483 bp, Homo sapiens; identical to SEQ ID NO: 542318
  misc_feature: HIJSMM301BVMDJ.13.59.F04.1.454.light.4.raw

SEQ ID NO: 579032 - DNA, 491 bp, Homo sapiens; identical to SEQ ID NO: 535294
  misc_feature: HIJSMM301C9KGZ.16.68.G02.1.454.light.4.raw

SEQ ID NO: 579033 - DNA, 494 bp, Homo sapiens
  misc_feature: HIJSMM301BF1WI.13.34.D01.1.454.light.4.raw
tcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtttattactgtcagcagtataataactggcctccgtacatgtacacttttggccaggggaccaacctggagatcagacgtaacg

SEQ ID NO: 579034 - DNA, 488 bp, Homo sapiens; identical to SEQ ID NO: 535990
  misc_feature: HIJSMM301CIAZU.11.28.C06.1.454.light.4.raw

SEQ ID NO: 579035 - DNA, 444 bp, Homo sapiens
  misc_feature: HIJSMM301BW5UX.9.9.A09.1.454.light.4.raw
tgatacgtctcacgaccggtgctcgatttagcgagacgcgcagggtcctgggcccagtctgtgctgacgcagccgccctcagtgtccggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcagacgtatca

SEQ ID NO: 579036 - DNA, 480 bp, Homo sapiens
  misc_feature: HIJSMM301BBGOX.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggtgttcgggcggagggacc

SEQ ID NO: 579037 - DNA, 488 bp, Homo sapiens
  misc_feature: HIJSMM301D08Z0.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatccagcagcctgcagtctgaagattttgcactttattactgtcagcaatataatgactggttctcgatcaccttcggccaagggacacgactggagattaaacgaactgtggctgcaccatctgtt

SEQ ID NO: 579038 - DNA, 521 bp, Homo sapiens; identical to SEQ ID NO: 539470
  misc_feature: HIJSMM301ET9D7.27.23.C01.1.454.light.4.raw

SEQ ID NO: 579039 - DNA, 521 bp, Homo sapiens; identical to SEQ ID NO: 539470
  misc_feature: HIJSMM301C666P.27.23.C01.1.454.light.4.raw

SEQ ID NO: 579040 - DNA, 491 bp, Homo sapiens; identical to SEQ ID NO: 535176
  misc_feature: HIJSMM301BLRCD.13.39.D06.1.454.light.4.raw

SEQ ID NO: 579041 - DNA, 505 bp, Homo sapiens
  misc_feature: HIJSMM301DVSLY.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactaattcggcggagggaccgaaagctgaccgtcctgcgtcagcccaaggctgccccctccggtcact

SEQ ID NO: 579042 - DNA, 511 bp, Homo sapiens
  misc_feature: HIJSMM301CNH5I.8.39.D06.1.454.light.4.raw
ctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctgggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctgagacacgcg

SEQ ID NO: 579043 - DNA, 509 bp, Homo sapiens
  misc_feature: HIJSMM301DL5AM.49.38.D05.1.454.light.4.raw
agtcgagagacacgaccggtgctcgatttagtatctgatagttgggtttgggggtgggtccaggaggcagaactctgggtgtctcaccatggcctggatccctctacttctccccctcctcactctctgcacaggctctgaggcctcctctgaattcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctcgtgttttcggcggagggaccaggctgaccgtcctgggtcagcccaaggctcgccccctcggtcactctcgttcccccg

SEQ ID NO: 579044 - DNA, 513 bp, Homo sapiens
  misc_feature: HIJSMM301EM5MJ.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccaccctcctcgctacgtaga

SEQ ID NO: 579045 - DNA, 493 bp, Homo sapiens; identical to SEQ ID NO: 542088
  misc_feature: HIJSMM301C7SNS.11.71.G05.1.454.light.4.raw

SEQ ID NO: 579046 - DNA, 503 bp, Homo sapiens
  misc_feature: HIJSMM301CH5H7.18.59.F04.1.454.light.4.raw
  modified_base (438)..(438): a, c, t, g, unknown or other
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcngcactcaagtcttggacgtaggccgaaggtcaccgtcctacgtgacgcccaacgccgaaccccaa

SEQ ID NO: 579047 - DNA, 494 bp, Homo sapiens; identical to SEQ ID NO: 535629
  misc_feature: HIJSMM301EARJH.4.27.C05.1.454.light.4.raw

SEQ ID NO: 579048 - DNA, 485 bp, Homo sapiens
  misc_feature: HIJSMM301C89EB.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtaggaaatcaaacgaactagtggctcg

SEQ ID NO: 579049 - DNA, 489 bp, Homo sapiens; identical to SEQ ID NO: 537328
  misc_feature: HIJSMM301A6FX3.13.5.A05.1.454.light.4.raw

SEQ ID NO: 579050 - DNA, 473 bp, Homo sapiens
  misc_feature: HIJSMM301ARYEJ.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcacttcggcgggggaccgaaggtggagatcaagcgaactgtggtc

SEQ ID NO: 579051 - DNA, 506 bp, Homo sapiens
  misc_feature: HIJSMM301BQJFP.49.31.C09.1.454.light.4.raw
agtcgagagacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattattactgcagctcatctgcaggcattaacaattttaatgtggtattcggcggagggaccaagctgaccgtctaggtcagcccaaggctgccccctcggtcactctgttcccg

SEQ ID NO: 579052 - DNA, 509 bp, Homo sapiens; identical to SEQ ID NO: 537131
  misc_feature: HIJSMM301CCCNN.17.33.C11.1.454.light.4.raw

SEQ ID NO: 579053 - DNA, 470 bp, Homo sapiens
  misc_feature: HIJSMM301C8LJY.49.8.A08.1.454.light.4.raw
agtcgagagacacgaccggtgctcgatttagcatactctacaggggaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtaccatcaaggttcagtggaagtggctctgggacagattttactttcaccatcagcagactgcagcctgaagatattgcaacatattactgtcaacagtatgatagtctcccgctcactttcggcggaggaccaaggtggagatcaaacgaactgtggc

SEQ ID NO: 579054 - DNA, 498 bp, Homo sapiens
  misc_feature: HIJSMM301D7TP7.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatccagtgggctccggtccgaggatgaggctgattattactgtgttggatgggacagcagcctgagtgcttatgtcttcggaactgggaccacggtcaccggtcct

SEQ ID NO: 579055 - DNA, 495 bp, Homo sapiens
  misc_feature: HIJSMM301CT7Y9.49.39.D06.1.454.light.4.raw
agtcgagagacacgaccggtgctcgatttagtgacatctcgcagttctttggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattgggactaattatgtttcctggtaccagcacctcccaggaacagcccccaaacgcctcatctatgaagataataagcgaccctcagggattcctgaccgattctctggctccaagtctggcacgtcagccaccctggacatcaccggactccagactggggacgaggccgattattactgcggaacatgggatagcagcctgagtgttgtgattttcggcggaggaccgaagctgaccgtcctac

SEQ ID NO: 579056 - DNA, 484 bp, Homo sapiens; identical to SEQ ID NO: 536162
  misc_feature: HIJSMM301ES59P.13.59.F04.1.454.light.4.raw

SEQ ID NO: 579057 - DNA, 497 bp, Homo sapiens
  misc_feature: HIJSMM301A9VSY.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagggtggaggctgaggatgttggggtttattactgcatgcaagctctacaacctctgcggactttcggccctgggaccaaagtggagatcaaacgaactgtggctgcaccatctgtcttcta

SEQ ID NO: 579058 - DNA, 493 bp, Homo sapiens; identical to SEQ ID NO: 536769
  misc_feature: HIJSMM301D7X9A.19.83.H06.1.454.light.4.raw

SEQ ID NO: 579059 - DNA, 505 bp, Homo sapiens
  misc_feature: HIJSMM301C5BAV.43.15.B04.1.454.light.4.raw
tgtgagtagtcacgaccggtgctcgatttagacagtatatatccgcggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaagggaccaaggtggaattcaaccgaactgtggctgcaccatctgtcttcatcttcccg

SEQ ID NO: 579060 - DNA, 521 bp, Homo sapiens
  misc_feature: HIJSMM301B4W5G.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgctacggacgacgacggaagacgtagacgaacgagtaggtcgtcgtcgaccgactactcgtcttcgtactcttcccgttccccg

SEQ ID NO: 579061 - DNA, 510 bp, Homo sapiens
  misc_feature: HIJSMM301EHDSX.40.16.B05.1.454.light.4.raw
tctagcgactcacgaccggtgctcgatttagagctcacgtaaggggggggtctcaggaggcagcactctcgggacgtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgctaggtagtttttgggtgttcggcggagggaccaaggctgaccgtcctaggtcagcccaaggctcgccccctcggtcactctcgttccc

SEQ ID NO: 579062 - DNA, 509 bp, Homo sapiens; identical to SEQ ID NO: 539359
  misc_feature: HIJSMM301B3DIH.47.85.H08.1.454.light.4.raw

SEQ ID NO: 579063 - DNA, 494 bp, Homo sapiens
  misc_feature: HIJSMM301EM70V.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagcccaaggccaacccactgtcact

SEQ ID NO: 579064 - DNA, 505 bp, Homo sapiens
  misc_feature: HIJSMM301D44LK.15.59.F04.1.454.light.4.raw
tctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtaa

SEQ ID NO: 579065 - DNA, 489 bp, Homo sapiens; identical to SEQ ID NO: 535139
  misc_feature: HIJSMM301BHXDW.14.55.E11.1.454.light.4.raw

SEQ ID NO: 579066 - DNA, 508 bp, Homo sapiens; identical to SEQ ID NO: 552440
  misc_feature: HIJSMM301AUIM4.5.24.C02.1.454.light.4.raw

SEQ ID NO: 579067 - DNA, 491 bp, Homo sapiens; identical to SEQ ID NO: 547053
  misc_feature: HIJSMM301AXX5K.3.33.C11.1.454.light.4.raw

SEQ ID NO: 579068 - DNA, 514 bp, Homo sapiens
  misc_feature: HIJSMM301EVWVE.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccgaccctcct

SEQ ID NO: 579069 - DNA, 500 bp, Homo sapiens
  misc_feature: HIJSMM301AVMBJ.3.27.C05.1.454.light.4.raw
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctgaccgattcaatggcagcgggtctggggcagatttcactctcaccatcagcagcctgcaggctgaagatgtggcagtttattactgtcagcaatattatactccgtcttccgacgttcggcaagggaccaaggtggaaatcaaacgaactgtggctgcaccat

SEQ ID NO: 579070 - DNA, 491 bp, Homo sapiens
  misc_feature: HIJSMM301BYFKJ.51.81.H04.1.454.light.4.raw
cgatcgtatacacgaccggtgctcgatttagtagtgtagattcgcgggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaac

SEQ ID NO: 579071 - DNA, 508 bp, Homo sapiens; identical to SEQ ID NO: 550380
  misc_feature: HIJSMM301BN0AA.4.57.F02.1.454.light.4.raw

SEQ ID NO: 579072 - DNA, 518 bp, Homo sapiens; identical to SEQ ID NO: 548899
  misc_feature: HIJSMM301DM894.41.25.C03.1.454.light.4.raw

SEQ ID NO: 579073 - DNA, 492 bp, Homo sapiens
  misc_feature: HIJSMM301ELE1A.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggtcggagggaccgaaggtggagatcaagcgaactgtggctgcaccatctgtctt

SEQ ID NO: 579074 - DNA, 499 bp, Homo sapiens
  misc_feature: HIJSMM301AEH7R.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaacggct

SEQ ID NO: 579075 - DNA, 489 bp, Homo sapiens; identical to SEQ ID NO: 536013
  misc_feature: HIJSMM301CIWER.26.23.C01.1.454.light.4.raw

SEQ ID NO: 579076 - DNA, 514 bp, Homo sapiens; identical to SEQ ID NO: 541418
  misc_feature: HIJSMM301DTVOZ.17.33.C11.1.454.light.4.raw

SEQ ID NO: 579077 - DNA, 496 bp, Homo sapiens
  misc_feature: HIJSMM301BJ9TC.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtggaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagaattaaacgaactgtggctgcaccatctgtctt

SEQ ID NO: 579078 - DNA, 516 bp, Homo sapiens
  misc_feature: HIJSMM301BVUS2.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctcgttcccaccctcctcgacc

SEQ ID NO: 579079 - DNA, 495 bp, Homo sapiens; identical to SEQ ID NO: 539509
  misc_feature: HIJSMM301ANPA6.26.72.G06.1.454.light.4.raw

SEQ ID NO: 579080 - DNA, 486 bp, Homo sapiens; identical to SEQ ID NO: 535043
  misc_feature: HIJSMM301AVWRO.46.35.D02.1.454.light.4.raw

SEQ ID NO: 579081 - DNA, 520 bp, Homo sapiens
  misc_feature: HIJSMM301DDFM8.43.81.H04.1.454.light.4.raw
  modified_base (495)..(495): a, c, t, g, unknown or other
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcgggcgggggactcagttgaccgtcctaggtcagcccaaggctgccccctcggtcnctctcgttcccgccctcctcaccta

SEQ ID NO: 579082 - DNA, 525 bp, Homo sapiens
  misc_feature: HIJSMM301B4CPJ.26.72.G06.1.454.light.4.raw
  modified_base (427)..(427): a, c, t, g, unknown or other
agactatactcacgaccggtgctcgatttagctacgactgcaaggggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtanactttggtccacgggaccgacggtggagagtcagactgatattaactaagcgaaaagaagatttttagttaaggggtaaagtaagtgaagtttaaacg

SEQ ID NO: 579083 - DNA, 512 bp, Homo sapiens
  misc_feature: HIJSMM301CGD02.52.41.D08.1.454.light.4.raw
cgcagtacgacacgaccggtgctcgatttagtcacgcgagaaagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaggcggctccaacatcggagggaatactgtgaactggtaccagcaactcccagggacggcccccagactcctcatctttagtcataatcagcggccctcaggggtccctgaccgattctctggctccaagtctggcacctcagcctccttggccatcagtgggctccagtctgacgatgaggctgattacttctgtgcaacttgggatgacagcctgaatggtccggtgttcggcggagggaccaagcttaccgttctgggtcagcccaaggctgccccctcggt

SEQ ID NO: 579084 - DNA, 490 bp, Homo sapiens; identical to SEQ ID NO: 535234
  misc_feature: HIJSMM301DLCE9.17.21.B10.1.454.light.4.raw

SEQ ID NO: 579085 - DNA, 503 bp, Homo sapiens; identical to SEQ ID NO: 573164
  misc_feature: HIJSMM301ECA4N.10.9.A09.1.454.light.4.raw

SEQ ID NO: 579086 - DNA, 505 bp, Homo sapiens; identical to SEQ ID NO: 545964
  misc_feature: HIJSMM301D7I0I.10.12.B01.1.454.light.4.raw

SEQ ID NO: 579087 - DNA, 498 bp, Homo sapiens; identical to SEQ ID NO: 536173
  misc_feature: HIJSMM301CEZJI.12.86.H09.1.454.light.4.raw

SEQ ID NO: 579088 - DNA, 491 bp, Homo sapiens
  misc_feature: HIJSMM301E3CY3.27.78.H01.1.454.light.4.raw
  modified_base (428)..(428): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcagngatcacctcgccaggacacgactcgagataaacgtaaacagtggcgtgcaccactctgtcttt

SEQ ID NO: 579089 - DNA, 493 bp, Homo sapiens; identical to SEQ ID NO: 540127
  misc_feature: HIJSMM301ATUJP.10.17.B06.1.454.light.4.raw

SEQ ID NO: 579090 - DNA, 517 bp, Homo sapiens; identical to SEQ ID NO: 536980
  misc_feature: HIJSMM301AIM1N.5.27.C05.1.454.light.4.raw

SEQ ID NO: 579091 - DNA, 506 bp, Homo sapiens; identical to SEQ ID NO: 535058
  misc_feature: HIJSMM301CJ4FA.17.41.D08.1.454.light.4.raw

SEQ ID NO: 579092 - DNA, 488 bp, Homo sapiens
  misc_feature: HIJSMM301BRIE0.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcacacggcctccctgaccatctctggcctccagcctgaggatgaggctgattattactgttgctcatatgcaggcggtaccgcttgggtgttcggcggagggaccaagctgaccgtcctaggtcagccccg

SEQ ID NO: 579093 - DNA, 497 bp, Homo sapiens
  misc_feature: HIJSMM301E2D9X.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgacgtcctaggtcagcccaaggct

SEQ ID NO: 579094 - DNA, 444 bp, Homo sapiens; identical to SEQ ID NO: 535594
  misc_feature: HIJSMM301EIKTP.9.9.A09.1.454.light.4.raw

SEQ ID NO: 579095 - DNA, 486 bp, Homo sapiens; identical to SEQ ID NO: 535043
  misc_feature: HIJSMM301BKB9P.46.35.D02.1.454.light.4.raw

SEQ ID NO: 579096 - DNA, 501 bp, Homo sapiens; identical to SEQ ID NO: 536142
  misc_feature: HIJSMM301A1LJR.15.1.A01.1.454.light.4.raw

SEQ ID NO: 579097 - DNA, 495 bp, Homo sapiens
  misc_feature: HIJSMM301ANB7X.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggtcaagggacacgactggagattaaacgaactagt

SEQ ID NO: 579098 - DNA, 404 bp, Homo sapiens; identical to SEQ ID NO: 535530
  misc_feature: HIJSMM301A6VED.4.35.D02.1.454.light.4.raw

SEQ ID NO: 579099 - DNA, 493 bp, Homo sapiens
  misc_feature: HIJSMM301DN86G.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttatactgtcagcaatattatattcctcctcagacgttcggccaagggaccaaggtggaaatcaaacgactgtgctgcacc

SEQ ID NO: 579100 - DNA, 493 bp, Homo sapiens; identical to SEQ ID NO: 541489
  misc_feature: HIJSMM301D3240.12.23.C01.1.454.light.4.raw

SEQ ID NO: 579101 - DNA, 485 bp, Homo sapiens; identical to SEQ ID NO: 535985
  misc_feature: HIJSMM301CQ388.15.1.A01.1.454.light.4.raw

SEQ ID NO: 579102 - DNA, 508 bp, Homo sapiens
  misc_feature: HIJSMM301B70XJ.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatacaaacgaactgtggctgcaccatctgtt

SEQ ID NO: 579103 - DNA, 507 bp, Homo sapiens; identical to SEQ ID NO: 568626
  misc_feature: HIJSMM301D5I1D.19.78.H01.1.454.light.4.raw

SEQ ID NO: 579104 - DNA, 493 bp, Homo sapiens; identical to SEQ ID NO: 535745
  misc_feature: HIJSMM301BS52R.47.78.H01.1.454.light.4.raw

SEQ ID NO: 579105 - DNA, 495 bp, Homo sapiens
  misc_feature: HIJSMM301D4XY9.9.1.A01.1.454.light.4.raw
tgatacgtctcacgaccggtgctcgatttagacgtctcatcgagggggagctgctcagttaggacccagagggaaccatggaaaccccagcgcagcttctcttcctcctgctactctggctcccagataccaccggagaaattgtgttgacgcagtctccgggcaccctgtctttctctccgaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcacatctgtcttcatcttccccg

SEQ ID NO: 579106 - DNA, 492 bp, Homo sapiens
  misc_feature: HIJSMM301DG539.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcaggtgggtctgggacagagttcactctcaccatcagcagcctgcagtctgatgatgttgctagtttattactgtcatcaatatggtcgacccggcccacggttccggaccaaggggaccaagggtggaaatcaaaacgactgtggctgcaccatctgtctt

SEQ ID NO: 579107 - DNA, 487 bp, Homo sapiens
  misc_feature: HIJSMM301AYYZ0.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggagtaatcagacgaa

SEQ ID NO: 579108 - DNA, 517 bp, Homo sapiens
  misc_feature: HIJSMM301C1ONU.17.28.C06.1.454.light.4.raw
cgtagactagcacgaccggtgctcgatttagagctcacgtattgggtttgggggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagccctccctgaccatcagtgggctccggtccgaggatgaggctgattattactgtgcaccgtgggatgacatcctgaatggtccggtgttcggcggagggaccaggctgaccgtcctaagtcagcccaaggctgccccctggtcactctgttcccaccct

SEQ ID NO: 579109 - DNA, 486 bp, Homo sapiens; identical to SEQ ID NO: 535043
  misc_feature: HIJSMM301EBAB1.46.35.D02.1.454.light.4.raw

SEQ ID NO: 579110 - DNA, 484 bp, Homo sapiens
  misc_feature: HIJSMM301CMIID.51.40.D07.1.454.light.4.raw
cgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacaggggtcccatcaaggttcagtggaagtggttctgggacagattttactttcaccatcagcagccttcaccctgaagatcttgcaacatattactgtcaacagtatgataatctcccactcactttcggcggagggaccaaggtggagatcaaacgaactgtggctgcacc

SEQ ID NO: 579111 - DNA, 509 bp, Homo sapiens
  misc_feature: HIJSMM301AKLYS.48.42.D09.1.454.light.4.raw
agtatacatacacgaccggtgctcgatttagacacatacgcagggaaagggggaagagctgctcagttaggacccagagggaaccatggaaaccccagcgcagcttctcttcctcctgctactctggctcccagatagcaccggagaaatcgtgttgacgcagtctccaggcaccctgtctgtgtctccaggggaaagagccaccctctcctgcagggccagtcagagtgttagcagcagctacttagcctggtaccagcagaaaccgggccaggctcccaggctcctcatctatggtgcatccagcagggccactggcatcccagacaggttcagttgcagtgggtctgggacagacttcactctcaccatcagcagacgtggacgcctgaagtatttgactaatttattactgtcagcagtatcggtacctccacccgacggtactacgttttcggccgacggggaccgaagctggagatacaaacgaactggtggctcgacaccta

SEQ ID NO: 579112 - DNA, 489 bp, Homo sapiens; identical to SEQ ID NO: 542296
  misc_feature: HIJSMM301BI5S0.17.21.B10.1.454.light.4.raw

SEQ ID NO: 579113 - DNA, 515 bp, Homo sapiens
  misc_feature: HIJSMM301AJRQ0.51.37.D04.1.454.light.4.raw
cgatcgtatacacgaccggtgctcgatttagtagcatactgttgggtttggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccgaacgggaccgaacggtggaaatacaacgaaactgtggctgcaccatctgtcttcattcc

SEQ ID NO: 579114 - DNA, 498 bp, Homo sapiens
  misc_feature: HIJSMM301CV1NK.13.9.A09.1.454.light.4.raw
tcacgtactacacgaccggtgctcgatttagcgagacgcgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctaaatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctgttcccgccct

SEQ ID NO: 579115 - DNA, 474 bp, Homo sapiens; identical to SEQ ID NO: 536662
  misc_feature: HIJSMM301CA27G.40.59.F04.1.454.light.4.raw

SEQ ID NO: 579116 - DNA, 512 bp, Homo sapiens
  misc_feature: HIJSMM301C5CZQ.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggcatttcggtgttcggtcggagggacccaggtgaccgtcctacgtcagcccaagg

SEQ ID NO: 579117 - DNA, 512 bp, Homo sapiens
  misc_feature: HIJSMM301CFWM2.7.39.D06.1.454.light.4.raw
cgtgtctctacacgaccggtgctcgatttagtgacatctcgcagttctttgggggtgggctcaggaggcagagctctgggaatctcaccatggcctggacccctctcctgctccccctcctcactttctgcacagtctctgaggcctcctatgaactgacacagccaccctcggtgtcagtgtccccaggacaaacggccaggatcacctgctctggaaatccatcgccaataagatctgttcattggtaccaccagaggtccggccaggcccctgtgcttgtcgtctatgcggacacaaagcgcccctccgggatccctgagagattctctggctccagctcagggacagtggccaccttgactatcagcggggcccaggtggacgatgaaggtgactacttctgtttctcaatagacgccagcggtgaccatagggtgttcggcggagggaccagggtgaccgtcctaggtcagcccaaggctgccccctcggtcactctgttcccgcct

SEQ ID NO: 579118 - DNA, 489 bp, Homo sapiens; identical to SEQ ID NO: 535139
  misc_feature: HIJSMM301ANQSX.14.55.E11.1.454.light.4.raw

SEQ ID NO: 579119 - DNA, 514 bp, Homo sapiens
  misc_feature: HIJSMM301D9UXE.17.33.C11.1.454.light.4.raw
  modified_base (507)..(507): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccnccctcct

SEQ ID NO: 579120 - DNA, 500 bp, Homo sapiens; identical to SEQ ID NO: 536183
  misc_feature: HIJSMM301D2YPX.10.17.B06.1.454.light.4.raw

SEQ ID NO: 579121 - DNA, 504 bp, Homo sapiens
  misc_feature: HIJSMM301CK5GR.21.26.C04.1.454.light.4.raw
tcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaagagccaccctctcctgcagggccagtcagattgttggcaacaactacttagcctggtaccagcagaaacctggccaggctcccaggctcctcatccatactgcctccaagagggccactggcatccctgacaggttcagtggcagtgggtctgggacagacttcactctcaccatcaccagactggagcctgatgattttgcagtttattactgccaccaacatgctttcgcaccgctcacgttcggcggagggaccagggtggagatcaaacgaactgtggctgcaccatctgtcttcatcc

SEQ ID NO: 579122 - DNA, 491 bp, Homo sapiens; identical to SEQ ID NO: 535194
  misc_feature: HIJSMM301AW68F.26.78.H01.1.454.light.4.raw

SEQ ID NO: 579123 - DNA, 495 bp, Homo sapiens; identical to SEQ ID NO: 535486
  misc_feature: HIJSMM301BUASU.26.72.G06.1.454.light.4.raw

SEQ ID NO: 579124 - DNA, 479 bp, Homo sapiens; identical to SEQ ID NO: 558912
  misc_feature: HIJSMM301BPHU3.40.23.C01.1.454.light.4.raw

SEQ ID NO: 579125 - DNA, 510 bp, Homo sapiens
  misc_feature: HIJSMM301CHDM3.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcacgccaaggctcgccccccg

SEQ ID NO: 579126 - DNA, 460 bp, Homo sapiens; identical to SEQ ID NO: 536053
  misc_feature: HIJSMM301CFN6L.22.28.C06.1.454.light.4.raw

SEQ ID NO: 579127 - DNA, 494 bp, Homo sapiens; identical to SEQ ID NO: 534994
  misc_feature: HIJSMM301BNNIQ.27.78.H01.1.454.light.4.raw

SEQ ID NO: 579128 - DNA, 488 bp, Homo sapiens
  misc_feature: HIJSMM301C9E5F.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggtattttgcagtttattactgtcagcattacaataactggcctcggctcactttcggcggagggaccaaggtggagatacaaacgaactgtggctgcaccat

SEQ ID NO: 579129 - DNA, 487 bp, Homo sapiens
  misc_feature: HIJSMM301DHHAI.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatggacggcagcctcagtgaatgggtgttcggcggagggaccaaaactgtccgtcctaggtcagacccg

SEQ ID NO: 579130 - DNA, 455 bp, Homo sapiens; identical to SEQ ID NO: 542082
  misc_feature: HIJSMM301AHBWD.19.86.H09.1.454.light.4.raw

SEQ ID NO: 579131 - DNA, 478 bp, Homo sapiens
  misc_feature: HIJSMM301CBQSU.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggctgttcgcggcgggcc

SEQ ID NO: 579132 - DNA, 491 bp, Homo sapiens
  misc_feature: HIJSMM301DWUQZ.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccg

SEQ ID NO: 579133 - DNA, 510 bp, Homo sapiens
  misc_feature: HIJSMM301D9QZM.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacgtttcggccctgggaccgaaggtggagatcaaacgaactgtggctgcaccatctgtcttcta

SEQ ID NO: 579134 - DNA, 460 bp, Homo sapiens; identical to SEQ ID NO: 540069
  misc_feature: HIJSMM301C46VX.11.86.H09.1.454.light.4.raw

SEQ ID NO: 579135 - DNA, 454 bp, Homo sapiens; identical to SEQ ID NO: 534964
  misc_feature: HIJSMM301BF9CM.19.86.H09.1.454.light.4.raw

SEQ ID NO: 579136 - DNA, 503 bp, Homo sapiens
  misc_feature: HIJSMM301EK0PM.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaagtggatatcaaacgaactgtggctgcaccatctgtctt

SEQ ID NO: 579137 - DNA, 512 bp, Homo sapiens; identical to SEQ ID NO: 556794
  misc_feature: HIJSMM301A57SL.17.33.C11.1.454.light.4.raw

SEQ ID NO: 579138 - DNA, 489 bp, Homo sapiens
  misc_feature: HIJSMM301A8QBT.48.67.G01.1.454.light.4.raw
agtatacatacacgaccggtgctcgatttagagtatacatattgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggaggaccaagctgacagtcctaggtcagcccaaggctgccccc

SEQ ID NO: 579139 - DNA, 505 bp, Homo sapiens; identical to SEQ ID NO: 536254
  misc_feature: HIJSMM301BEGRS.7.71.G05.1.454.light.4.raw

SEQ ID NO: 579140 - DNA, 503 bp, Homo sapiens
  misc_feature: HIJSMM301BTY8C.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgtctactttatttactgtcagcagcgtagcaactggcctctcacttcggtcggagggaccgagggtgagggggggatcgagacgaactgtggcgtg

SEQ ID NO: 579141 - DNA, 478 bp, Homo sapiens
  misc_feature: HIJSMM301DYF9U.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccggagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctgca

SEQ ID NO: 579142 - DNA, 441 bp, Homo sapiens; identical to SEQ ID NO: 534971
  misc_feature: HIJSMM301A0914.11.3.A03.1.454.light.4.raw

SEQ ID NO: 579143 - DNA, 516 bp, Homo sapiens
  misc_feature: HIJSMM301D70ZD.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctacaaaaagagtagcctctcgtggtttcggcgggggaccaaggtgaccgtcctaagtcagccaaggctcgccccctcggtcactctgttcccaccctcctc

SEQ ID NO: 579144 - DNA, 486 bp, Homo sapiens; identical to SEQ ID NO: 536261
  misc_feature: HIJSMM301BPFLC.26.55.E11.1.454.light.4.raw

SEQ ID NO: 579145 - DNA, 485 bp, Homo sapiens
  misc_feature: HIJSMM301B5Y3M.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcccgcaggctgaagatgtggcagcttattattgtcagcaatattatacttctcttccgatcacttttggccgagggaccgaggctggagatcagacgaactgt

SEQ ID NO: 579146 - DNA, 462 bp, Homo sapiens; identical to SEQ ID NO: 549716
  misc_feature: HIJSMM301CM7W7.11.73.G07.1.454.light.4.raw

SEQ ID NO: 579147 - DNA, 497 bp, Homo sapiens
  misc_feature: HIJSMM301AVR5X.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagtattttgctagtttattactgtcagcagtataataactggcctccgtacatgtactacgttttggccgagggaccaacctggagatcagacgaa

SEQ ID NO: 579148 - DNA, 520 bp, Homo sapiens
  misc_feature: HIJSMM301AVDFP.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagttgccctcaccatcacgggggcccaggcagacgatgaatgtgattatcactgcgtcctttatgtggggcgtggcatttgggtgttcggcggagggaccaaactgaccggtcctaggtcagcccaaggctgccccctggtcactctgttccccg

SEQ ID NO: 579149 - DNA, 500 bp, Homo sapiens; identical to SEQ ID NO: 541872
  misc_feature: HIJSMM301A1W1Z.48.82.H05.1.454.light.4.raw

SEQ ID NO: 579150 - DNA, 492 bp, Homo sapiens; identical to SEQ ID NO: 540428
  misc_feature: HIJSMM301EAEEY.51.81.H04.1.454.light.4.raw

SEQ ID NO: 579151 - DNA, 486 bp, Homo sapiens; identical to SEQ ID NO: 535043
  misc_feature: HIJSMM301B76KJ.46.35.D02.1.454.light.4.raw

SEQ ID NO: 579152 - DNA, 513 bp, Homo sapiens
  misc_feature: HIJSMM301BHYNA.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtccactctgttccccg

SEQ ID NO: 579153 - DNA, 501 bp, Homo sapiens
  misc_feature: HIJSMM301BECSP.22.15.B04.1.454.light.4.raw
acatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcatccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggt

SEQ ID NO: 579154 - DNA, 488 bp, Homo sapiens; identical to SEQ ID NO: 542699
  misc_feature: HIJSMM301AG5N7.12.51.E07.1.454.light.4.raw

SEQ ID NO: 579155 - DNA, 516 bp, Homo sapiens
  misc_feature: HIJSMM301A21D6.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaaggaccgaacggtaggaagtacaaacgaactagtggcgtgcaccactctgtcttctactcttcccgccctact

SEQ ID NO: 579156 - DNA, 507 bp, Homo sapiens
  misc_feature: HIJSMM301BZMGU.48.34.D01.1.454.light.4.raw
agtatacatacacgaccggtgctcgatttagatcgtctgtgttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctgttccccg

SEQ ID NO: 579157 - DNA, 498 bp, Homo sapiens
  misc_feature: HIJSMM301DOSO5.18.59.F04.1.454.light.4.raw
tacgagtatgcacgaccggtgctcgatttagtacacacacttagggattggggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggccaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaagg

SEQ ID NO: 579158 - DNA, 503 bp, Homo sapiens
  misc_feature: HIJSMM301CRH7A.8.24.C02.1.454.light.4.raw
ctcgcgtgtccacgaccggtgctcgatttagtacagatcgttagggaaagggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagtccccaaactcatcatttatgatgtcactgatcgcccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagttgaccgtcctaagtcagcccaaggctgccccctc

SEQ ID NO: 579159 - DNA, 503 bp, Homo sapiens
  misc_feature: HIJSMM301CKCWX.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgtttcggcggagggaccaaaggtggagatcaaacgaactgtggctgcaccatctgtctt

SEQ ID NO: 579160 - DNA, 513 bp, Homo sapiens; identical to SEQ ID NO: 539258
  misc_feature: HIJSMM301EVDTC.43.19.B08.1.454.light.4.raw

SEQ ID NO: 579161 - DNA, 500 bp, Homo sapiens
  misc_feature: HIJSMM301A81ES.11.74.G08.1.454.light.4.raw
cgagagataccacgaccggtgctcgatttagtagctctatcaggggggggtcgtcaggaggcagtgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacattggtggttataactatgtctcctggtaccaacaacacccagacaaagcccccaaactcatgatttatgaggtcactaagcggccctcaggggtccctgatcgcttctctggctccaagtctggcaacacggcctccctgaccgtctctgggctccaggctgacgatgaggctgattattattgcagctcatatgcaggcagcaccaatttggtgttcggcgggagggaccaagctcgaccgtcctaggtcagcccaaggctgccccctcggt

SEQ ID NO: 579162 - DNA, 514 bp, Homo sapiens
  misc_feature: HIJSMM301DRZ5G.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtaggaggaatcaaacgaaactagtggctgcaccaatctgttcttctatcttcccgccact

SEQ ID NO: 579163 - DNA, 442 bp, Homo sapiens
  misc_feature: HIJSMM301EC9NZ.11.3.A03.1.454.light.4.raw
  modified_base (424)..(424): a, c, t, g, unknown or other
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctcgttcccnccctcctcgtatctctcg

SEQ ID NO: 579164 - DNA, 482 bp, Homo sapiens
  misc_feature: HIJSMM301CTJDF.13.6.A06.1.454.light.4.raw
tcacgtactacacgaccggtgctcgatttagatctactgacaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtcctaggtcagcccaa

SEQ ID NO: 579165 - DNA, 503 bp, Homo sapiens
  misc_feature: HIJSMM301DCT1E.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtccctcctctcacgttcggcggagggaccaaggtggaagatcaaacgaactgtggctgcaccatctgtctt

SEQ ID NO: 579166 - DNA, 492 bp, Homo sapiens; identical to SEQ ID NO: 565833
  misc_feature: HIJSMM301EE8A9.16.68.G02.1.454.light.4.raw

SEQ ID NO: 579167 - DNA, 354 bp, Homo sapiens; identical to SEQ ID NO: 535026
  misc_feature: HIJSMM301CSW5F.19.22.B11.1.454.light.4.raw

SEQ ID NO: 579168 - DNA, 487 bp, Homo sapiens; identical to SEQ ID NO: 538190
  misc_feature: HIJSMM301CD9EB.47.70.G04.1.454.light.4.raw

SEQ ID NO: 579169 - DNA, 512 bp, Homo sapiens; identical to SEQ ID NO: 552719
  misc_feature: HIJSMM301EPZVZ.22.36.D03.1.454.light.4.raw

SEQ ID NO: 579170 - DNA, 480 bp, Homo sapiens
  misc_feature: HIJSMM301D3K4S.5.12.B01.1.454.light.4.raw
  modified_base (462)..(462): a, c, t, g, unknown or other
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctgttcccnccctcctccgtgtctgat

SEQ ID NO: 579171 - DNA, 486 bp, Homo sapiens
  misc_feature: HIJSMM301BZCXH.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaa

SEQ ID NO: 579172 - DNA, 469 bp, Homo sapiens; identical to SEQ ID NO: 550603
  misc_feature: HIJSMM301EMGDQ.51.75.G09.1.454.light.4.raw

SEQ ID NO: 579173 - DNA, 490 bp, Homo sapiens; identical to SEQ ID NO: 535234
  misc_feature: HIJSMM301D4EE1.17.21.B10.1.454.light.4.raw

SEQ ID NO: 579174 - DNA, 519 bp, Homo sapiens
  misc_feature: HIJSMM301EN55M.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacgaattcactctcaccatcgctgatctgcagcctgaagattttgcaacttactactgtcaacagagtttcagtgtccccccggacgttcgtccgacgggaccgaccgacgtagaaataggaagacgaaactacgtggcgtgcaccactctcgtcttcctatcttcccgt

SEQ ID NO: 579175 - DNA, 512 bp, Homo sapiens; identical to SEQ ID NO: 558719
  misc_feature: HIJSMM301BIVXK.41.30.C08.1.454.light.4.raw

SEQ ID NO: 579176 - DNA, 486 bp, Homo sapiens; identical to SEQ ID NO: 535385
  misc_feature: HIJSMM301BX8CI.19.71.G05.1.454.light.4.raw

SEQ ID NO: 579177 - DNA, 488 bp, Homo sapiens; identical to SEQ ID NO: 535861
  misc_feature: HIJSMM301A5RDS.14.55.E11.1.454.light.4.raw

SEQ ID NO: 579178 - DNA, 500 bp, Homo sapiens
  misc_feature: HIJSMM301BFNMB.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttaatccgtggacgttcggtccaagggaccagggtggaaagtacaaacgaactagtggctgcaccatctgtcttcatt

SEQ ID NO: 579179 - DNA, 496 bp, Homo sapiens
  misc_feature: HIJSMM301C6YP4.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccagggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacaggacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 579180 - DNA, 486 bp, Homo sapiens
  misc_feature: HIJSMM301DQV5J.48.38.D05.1.454.light.4.raw
agtatacatacacgaccggtgctcgatttagtatctgatagttgggtttggggagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgca

SEQ ID NO: 579181 - DNA, 498 bp, Homo sapiens
  misc_feature: HIJSMM301DQSC3.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaacgggaccgaacggtggaaatacaaacgaactagtggctgcaccaactctgtt

SEQ ID NO: 579182 - DNA, 520 bp, Homo sapiens; identical to SEQ ID NO: 540293
  misc_feature: HIJSMM301DUJS2.27.23.C01.1.454.light.4.raw

SEQ ID NO: 579183 - DNA, 489 bp, Homo sapiens; identical to SEQ ID NO: 535139
  misc_feature: HIJSMM301CTL76.14.55.E11.1.454.light.4.raw

SEQ ID NO: 579184 - DNA, 491 bp, Homo sapiens
  misc_feature: HIJSMM301EF24N.41.2.A02.1.454.light.4.raw
  modified_base (473)..(473): a, c, t, g, unknown or other
tctatactatcacgaccggtgctcgatttagactcatctacagggggcaggagtcagtcccaaccaggacacagcatggacatgagggtccctgctcagctcctggggctcctgctgctctggctctcaggcgccagatgtgacatccagatgacccagtctccatcctccctgtctacatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctccccttagtttcggcggtagggaccaaggttgagatcaaacgaactgtggntgcaccatctgtcttcta

SEQ ID NO: 579185 - DNA, 494 bp, Homo sapiens; identical to SEQ ID NO: 534992
  misc_feature: HIJSMM301AYP0Z.9.1.A01.1.454.light.4.raw

SEQ ID NO: 579186 - DNA, 520 bp, Homo sapiens; identical to SEQ ID NO: 540293
  misc_feature: HIJSMM301B1UVK.27.23.C01.1.454.light.4.raw

SEQ ID NO: 579187 - DNA, 454 bp, Homo sapiens
  misc_feature: HIJSMM301D622T.19.86.H09.1.454.light.4.raw
tactctcgtgcacgaccggtgctcgatttagtgctatagacttgggtttgggggccgttcctgggcccagtctgtgttgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctaagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 579188 - DNA, 494 bp, Homo sapiens; identical to SEQ ID NO: 536974
  misc_feature: HIJSMM301AGS4Z.16.86.H09.1.454.light.4.raw

SEQ ID NO: 579189 - DNA, 419 bp, Homo sapiens
  misc_feature: HIJSMM301C04JN.9.34.D01.1.454.light.4.raw
tgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaacccactgtcactctgttcccaccctcctcagacgtatca

SEQ ID NO: 579190 - DNA, 514 bp, Homo sapiens
  misc_feature: HIJSMM301BIZYX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaacgggaccgaacggtagggaaagtacaaacgaactagtggctgcaccatctgtcttctatcttccccg

SEQ ID NO: 579191 - DNA, 471 bp, Homo sapiens
  misc_feature: HIJSMM301CXKXB.49.73.G07.1.454.light.4.raw
agtcgagagacacgaccggtgctcgatttagctctacgctcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctccgctcactttcggcggagggaccaaggtggagatcaaacgaactgtggctgcaccta

SEQ ID NO: 579192 - DNA, 483 bp, Homo sapiens
  misc_feature: HIJSMM301DNL8W.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttccgccatctgactagtctacg

SEQ ID NO: 579193 - DNA, 487 bp, Homo sapiens; identical to SEQ ID NO: 537573
  misc_feature: HIJSMM301A3HGG.3.10.A10.1.454.light.4.raw

SEQ ID NO: 579194 - DNA, 486 bp, Homo sapiens
  misc_feature: HIJSMM301B9N82.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggtccaggggaccaagctggagatcaaacgaactgtggctgcacc

SEQ ID NO: 579195 - DNA, 473 bp, Homo sapiens; identical to SEQ ID NO: 535262
  misc_feature: HIJSMM301EFCV2.8.67.G01.1.454.light.4.raw

SEQ ID NO: 579196 - DNA, 454 bp, Homo sapiens
  misc_feature: HIJSMM301BP0O5.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttttggcggagggaccaagctgaccgtcctaagtcagcccaaggctgccccctcggtcactctgttcccaccctcctccacgagagta

SEQ ID NO: 579197 - DNA, 500 bp, Homo sapiens; identical to SEQ ID NO: 542247
  misc_feature: HIJSMM301BL9PB.19.78.H01.1.454.light.4.raw

SEQ ID NO: 579198 - DNA, 514 bp, Homo sapiens; identical to SEQ ID NO: 546238
  misc_feature: HIJSMM301BE8NO.47.85.H08.1.454.light.4.raw

SEQ ID NO: 579199 - DNA, 504 bp, Homo sapiens; identical to SEQ ID NO: 538940
  misc_feature: HIJSMM301DVVCI.2.35.D02.1.454.light.4.raw

SEQ ID NO: 579200 - DNA, 505 bp, Homo sapiens
  misc_feature: HIJSMM301CZOO4.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgctagtttattactgtcagcaggcggggcaagttggccgctcacgtttcggcggggggaccaaggtggagttcaaacgaactgtggctgcaccatctgtcttcatcttccg

SEQ ID NO: 579201 - DNA, 485 bp, Homo sapiens; identical to SEQ ID NO: 540394
  misc_feature: HIJSMM301DPLFE.46.26.C04.1.454.light.4.raw

SEQ ID NO: 579202 - DNA, 491 bp, Homo sapiens
  misc_feature: HIJSMM301A14BU.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaaacgaactagtggctgcaccatctgtcttcatt

SEQ ID NO: 579203 - DNA, 478 bp, Homo sapiens; identical to SEQ ID NO: 535129
  misc_feature: HIJSMM301CF3ZL.11.11.A11.1.454.light.4.raw

SEQ ID NO: 579204 - DNA, 473 bp, Homo sapiens
  misc_feature: HIJSMM301ETFJ2.3.1.A01.1.454.light.4.raw
agacgcactccacgaccggtgctcgatttagacgtctcatcagggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagtattggacgttcggccaagggaccaagatagaaatcaaacgaactgtggctgcaccat

SEQ ID NO: 579205 - DNA, 505 bp, Homo sapiens
  misc_feature: HIJSMM301CQPMO.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtccactctgtt

SEQ ID NO: 579206 - DNA, 495 bp, Homo sapiens
  misc_feature: HIJSMM301EB91L.13.39.D06.1.454.light.4.raw
  modified_base (234)..(234): a, c, t, g, unknown or other
tcacgtactacacgaccggtgctcgatttagtgacatctcgcagttctttggggagctacaacaggcaggcaggggcagcaagatggtgttgcagacccaggtcttcatttctctgttgctatggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgtaacg

SEQ ID NO: 579207 - DNA, 499 bp, Homo sapiens
  misc_feature: HIJSMM301B43OO.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtaggcagtgggtctgggacagacttcactctcaccatcagcagactggagcctgaagattttgcagtgtattactgtcagcagtatggtagctcacctcggacgttcggtccgaggaccgaacggtaggaagtacaaacgaactagtggcgtgcaccactctgtt

SEQ ID NO: 579208 - DNA, 505 bp, Homo sapiens
  misc_feature: HIJSMM301C9WMI.48.8.A08.1.454.light.4.raw
agtatacatacacgaccggtgctcgatttagcatactctacaggggggaggaacccctcagttaggacccagagggaaccatggaagccccagctcagcttctcttcctcctgctactctggctcccaggttttaccggagagattgtgttgacacagtctccagtcaccctgtcattgtctccagggcaaagagccaccctctcctgcagggccaatgagagtattggcaacttcttaggctggtatcaacaaaagcctggccaggctcccaggctcctcatctatgatgcatcccatagggccagaggcatcccagccaggttcagtggcagtgggtctgggacagacttcactctcaccatcagcaccctagaacgtgaagattttgcagtttattactgttcagcaccgtaaaacctggcctctgagtggttttggccaggggaccaagctggacatcaaacgaactgtggctgcaccatctgtcttcatcttcccgtcca

SEQ ID NO: 579209 - DNA, 491 bp, Homo sapiens
  misc_feature: HIJSMM301EMJ98.48.28.C06.1.454.light.4.raw
agtatacatacacgaccggtgctcgatttagagctcacgtattgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccc

SEQ ID NO: 579210 - DNA, 521 bp, Homo sapiens; identical to SEQ ID NO: 539470
  misc_feature: HIJSMM301BYYK0.27.23.C01.1.454.light.4.raw

SEQ ID NO: 579211 - DNA, 473 bp, Homo sapiens
  misc_feature: HIJSMM301B55WP.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctccgctcactttcggcgggggacgaaggtggagatcaagcgaactgtggctgca

SEQ ID NO: 579212 - DNA, 474 bp, Homo sapiens; identical to SEQ ID NO: 541431
  misc_feature: HIJSMM301EMB23.4.14.B03.1.454.light.4.raw

SEQ ID NO: 579213 - DNA, 487 bp, Homo sapiens
  misc_feature: HIJSMM301BJCLL.13.87.H10.1.454.light.4.raw
tcacgtactacacgaccggtgctcgatttagcagtactgcgttgggtttggggaggtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtgggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtgctgcaccatctgtt

SEQ ID NO: 579214 - DNA, 486 bp, Homo sapiens; identical to SEQ ID NO: 535043
  misc_feature: HIJSMM301A5GIU.46.35.D02.1.454.light.4.raw

SEQ ID NO: 579215 - DNA, 476 bp, Homo sapiens; identical to SEQ ID NO: 537368
  misc_feature: HIJSMM301DFE5R.7.83.H06.1.454.light.4.raw

SEQ ID NO: 579216 - DNA, 477 bp, Homo sapiens; identical to SEQ ID NO: 539715
  misc_feature: HIJSMM301DWMN8.48.51.E07.1.454.light.4.raw

SEQ ID NO: 579217 - DNA, 486 bp, Homo sapiens; identical to SEQ ID NO: 535043
  misc_feature: HIJSMM301CU9P0.46.35.D02.1.454.light.4.raw

SEQ ID NO: 579218 - DNA, 506 bp, Homo sapiens; identical to SEQ ID NO: 535058
  misc_feature: HIJSMM301CI8IH.17.41.D08.1.454.light.4.raw

SEQ ID NO: 579219 - DNA, 500 bp, Homo sapiens; identical to SEQ ID NO: 560122
  misc_feature: HIJSMM301AGY2O.9.81.H04.1.454.light.4.raw

SEQ ID NO: 579220 - DNA, 489 bp, Homo sapiens; identical to SEQ ID NO: 551189
  misc_feature: HIJSMM301DPFA4.7.85.H08.1.454.light.4.raw

SEQ ID NO: 579221 - DNA, 508 bp, Homo sapiens
  misc_feature: HIJSMM301ATBBR.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtctaggtcagcccaaggctgccccctggtcactctcgttcccacctccc

SEQ ID NO: 579222 - DNA, 508 bp, Homo sapiens
  misc_feature: HIJSMM301D6MWP.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtcggggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcta

SEQ ID NO: 579223 - DNA, 501 bp, Homo sapiens; identical to SEQ ID NO: 577684
  misc_feature: HIJSMM301AZ81Q.10.36.D03.1.454.light.4.raw

SEQ ID NO: 579224 - DNA, 454 bp, Homo sapiens; identical to SEQ ID NO: 535705
  misc_feature: HIJSMM301C6N98.5.86.H09.1.454.light.4.raw

SEQ ID NO: 579225 - DNA, 485 bp, Homo sapiens; identical to SEQ ID NO: 535880
  misc_feature: HIJSMM301CLBMH.7.75.G09.1.454.light.4.raw

SEQ ID NO: 579226 - DNA, 487 bp, Homo sapiens
  misc_feature: HIJSMM301BK54S.41.10.A10.1.454.light.4.raw
  modified_base (393)..(393): a, c, t, g, unknown or other
tctatactatcacgaccggtgctcgatttagcgtcgatctcagggggcatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtnttactgtcatcagagtcgtagtttacctcaaacgttcggccaagggaccaaggtggaaatcaaacgaactgtggctgcaccatctgtcttcatt

SEQ ID NO: 579227 - DNA, 502 bp, Homo sapiens
  misc_feature: HIJSMM301AJETO.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttaccttcaagtagatcaccttcggccaagggacgacgactggagattaaacgtaaactagtggcgtgcaccatctgtcttt

SEQ ID NO: 579228 - DNA, 520 bp, Homo sapiens
  misc_feature: HIJSMM301C6AY9.41.87.H10.1.454.light.4.raw
tctatactatcacgaccggtgctcgatttagcagtactgcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgttcccg

SEQ ID NO: 579229 - DNA, 485 bp, Homo sapiens
  misc_feature: HIJSMM301B26NE.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgagatttgcagtttatactgtcagcagtataatgactggcctccgacgttcggccaagggaccaaggtggaaatcaaacgaactgtggctgcaccat

SEQ ID NO: 579230 - DNA, 494 bp, Homo sapiens; identical to SEQ ID NO: 534992
  misc_feature: HIJSMM301AJWI4.9.1.A01.1.454.light.4.raw

SEQ ID NO: 579231 - DNA, 434 bp, Homo sapiens; identical to SEQ ID NO: 535153
  misc_feature: HIJSMM301BAK32.18.5.A05.1.454.light.4.raw

SEQ ID NO: 579232 - DNA, 502 bp, Homo sapiens; identical to SEQ ID NO: 536253
  misc_feature: HIJSMM301EU1RE.21.22.B11.1.454.light.4.raw

SEQ ID NO: 579233 - DNA, 516 bp, Homo sapiens
  misc_feature: HIJSMM301C9088.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccacctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgt

SEQ ID NO: 579234 - DNA, 499 bp, Homo sapiens
  misc_feature: HIJSMM301B1XAO.43.34.D01.1.454.light.4.raw
tgtgagtagtcacgaccggtgctcgatttagatcgtctgtgttgggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccaccctcctcactactcaca

SEQ ID NO: 579235 - DNA, 496 bp, Homo sapiens; identical to SEQ ID NO: 567169
  misc_feature: HIJSMM301CNCKF.41.18.B07.1.454.light.4.raw

SEQ ID NO: 579236 - DNA, 502 bp, Homo sapiens; identical to SEQ ID NO: 536253
  misc_feature: HIJSMM301BNR8G.21.22.B11.1.454.light.4.raw

SEQ ID NO: 579237 - DNA, 486 bp, Homo sapiens; identical to SEQ ID NO: 537144
  misc_feature: HIJSMM301DNXBL.46.35.D02.1.454.light.4.raw

SEQ ID NO: 579238 - DNA, 495 bp, Homo sapiens
  misc_feature: HIJSMM301BI9U2.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagatttttactctcggcatccgcagcctgcagcctgaagattttgcgacatattactgtcaacagtatgaaaatgtcccgctcactttcggcgggggaccaaggtggagttcaaacgaactgtggctgcaccatctgtcttcatt

SEQ ID NO: 579239 - DNA, 518 bp, Homo sapiens; identical to SEQ ID NO: 563314
  misc_feature: HIJSMM301AZ6OR.14.70.G04.1.454.light.4.raw

SEQ ID NO: 579240 - DNA, 516 bp, Homo sapiens; identical to SEQ ID NO: 546969
  misc_feature: HIJSMM301B5TZR.22.30.C08.1.454.light.4.raw

SEQ ID NO: 579241 - DNA, 521 bp, Homo sapiens
  misc_feature: HIJSMM301DN78R.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtgccgtaggacgaacggtaggaggtacaaacgaaacagtggtcgcgtcgaccactctcgtcttctactcttcccgccctactcctgt

SEQ ID NO: 579242 - DNA, 495 bp, Homo sapiens
  misc_feature: HIJSMM301CRIOL.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaaggtggagttcaaacgaactgtggctgcaccatctgtcttcatt

SEQ ID NO: 579243 - DNA, 474 bp, Homo sapiens; identical to SEQ ID NO: 561309
  misc_feature: HIJSMM301E2DZQ.5.12.B01.1.454.light.4.raw

SEQ ID NO: 579244 - DNA, 447 bp, Homo sapiens; identical to SEQ ID NO: 535020
  misc_feature: HIJSMM301BXCKX.18.9.A09.1.454.light.4.raw

SEQ ID NO: 579245 - DNA, 497 bp, Homo sapiens
  misc_feature: HIJSMM301BQYDF.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgctagtttattactgtcagcagtataataactggttcctgctcactttcgggcgggggaccgaaggtggagatacaaacgaactgtggctgcaccatctgtt

SEQ ID NO: 579246 - DNA, 489 bp, Homo sapiens; identical to SEQ ID NO: 554654
  misc_feature: HIJSMM301CH1XQ.43.82.H05.1.454.light.4.raw

SEQ ID NO: 579247 - DNA, 493 bp, Homo sapiens
  misc_feature: HIJSMM301C610E.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcgccccccg

SEQ ID NO: 579248 - DNA, 494 bp, Homo sapiens
  misc_feature: HIJSMM301BAYP1.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacgatcaagcgaacctagtggctgcaccatctgtt

SEQ ID NO: 579249 - DNA, 488 bp, Homo sapiens
  misc_feature: HIJSMM301EVSUX.14.55.E11.1.454.light.4.raw
  modified_base (425)..(425): a, c, t, g, unknown or other
cgtctagtaccacgaccggtgctcgatttagcactcgcacgttgggtttgggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagccctgacctcctgatctatgctgcatccagtttgcacagtgggtccgtcaaggttcagtggcagtggatctgggacagatttcactctcaccgtcagcagtctgcaacctgaagattttgcaacttactactgtcaacagagttacagtacccccctnactttcggcggtaagggaccgaagggcggagatcagacgaactgtggctgcaccatctgtctt

SEQ ID NO: 579250 - DNA, 484 bp, Homo sapiens
  misc_feature: HIJSMM301EA0C8.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccgaagctgaccgtcctaggtcagcccg

SEQ ID NO: 579251 - DNA, 506 bp, Homo sapiens
  misc_feature: HIJSMM301CNAY1.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcacgcccaaggctcgccccctcggtcta

SEQ ID NO: 579252 - DNA, 508 bp, Homo sapiens; identical to SEQ ID NO: 540640
  misc_feature: HIJSMM301BNYSP.5.60.F05.1.454.light.4.raw

SEQ ID NO: 579253 - DNA, 521 bp, Homo sapiens; identical to SEQ ID NO: 538715
  misc_feature: HIJSMM301ASEK0.27.23.C01.1.454.light.4.raw

SEQ ID NO: 579254 - DNA, 504 bp, Homo sapiens
  misc_feature: HIJSMM301C9XYR.41.30.C08.1.454.light.4.raw
tctatactatcacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgattattactgcagctcatatacaagcagcagcactctcgtggtattcggcgagggaccaagctgaccgtcctaggtcagcccaaggctgcccctc

SEQ ID NO: 579255 - DNA, 496 bp, Homo sapiens; identical to SEQ ID NO: 541772
  misc_feature: HIJSMM301C77SM.51.81.H04.1.454.light.4.raw

SEQ ID NO: 579256 - DNA, 500 bp, Homo sapiens
  misc_feature: HIJSMM301CKZRV.9.53.E09.1.454.light.4.raw
tgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcgggcggagggaccaaggtgaccgtcctaggtcagcccaaggctcgcccccttc

SEQ ID NO: 579257 - DNA, 503 bp, Homo sapiens; identical to SEQ ID NO: 539976
  misc_feature: HIJSMM301CG5VF.47.55.E11.1.454.light.4.raw

SEQ ID NO: 579258 - DNA, 500 bp, Homo sapiens
  misc_feature: HIJSMM301AE0HV.40.80.H03.1.454.light.4.raw
tctagcgactcacgaccggtgctcgatttagctgtgcgtcgaagggaaagggggagtcagacccagtcaggacacagcatggacatgagggtccccgctcagctcctggggctcctgctgctctggctcccaggtaccaagtgtgacatccagatgacccagtctccctccgccctgtctgcatctgtaggagacagagtcaccataatctgccgggccagtcagactgttaataggtggttggcctggtatcagcagaaacctgggaaagcccctagcctcctgatctctgagacatctatcttacaaactggggtcccagccaggttcagcggcagtgtttctgggacagacttcagtctcaccatcagcagcctacagcctgatgattctgcaacttattggtgccaacaatataacagttatccgtacactttcggtccgagggacgtaagacgtggaggatacaaacgaaactacgtggcgtgcaccactcttcg

SEQ ID NO: 579259 - DNA, 498 bp, Homo sapiens; identical to SEQ ID NO: 548544
  misc_feature: HIJSMM301EXE8T.22.14.B03.1.454.light.4.raw

SEQ ID NO: 579260 - DNA, 497 bp, Homo sapiens; identical to SEQ ID NO: 578982
  misc_feature: HIJSMM301EVOXC.41.53.E09.1.454.light.4.raw

SEQ ID NO: 579261 - DNA, 488 bp, Homo sapiens
  misc_feature: HIJSMM301EMKHQ.10.72.G06.1.454.light.4.raw
catagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaa

SEQ ID NO: 579262 - DNA, 468 bp, Homo sapiens; identical to SEQ ID NO: 571475
  misc_feature: HIJSMM301B4Q83.7.81.H04.1.454.light.4.raw

SEQ ID NO: 579263 - DNA, 498 bp, Homo sapiens
  misc_feature: HIJSMM301C5CE4.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggataggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactgtggctgcacc

SEQ ID NO: 579264 - DNA, 490 bp, Homo sapiens
  misc_feature: HIJSMM301EO6I6.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtcttcta

SEQ ID NO: 579265 - DNA, 510 bp, Homo sapiens
  misc_feature: HIJSMM301EXGDM.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcattcttcggagggccactgggtcgtcccagcccaggttcagtggcaggtgggtctggaacagagttcactctcaccatcagcggcctgcagtctgaagtattttgctagtttattactgtcagcagtataatgacttgggttttattctactttcggtcccgtcgggaccaaagtaggatttcagacgaactggtggctgcaccactcttcgtcttcta

SEQ ID NO: 579266 - DNA, 508 bp, Homo sapiens; identical to SEQ ID NO: 545298
  misc_feature: HIJSMM301D2JJR.8.42.D09.1.454.light.4.raw

SEQ ID NO: 579267 - DNA, 488 bp, Homo sapiens; identical to SEQ ID NO: 551155
  misc_feature: HIJSMM301ALFGI.3.33.C11.1.454.light.4.raw

SEQ ID NO: 579268 - DNA, 513 bp, Homo sapiens
  misc_feature: HIJSMM301A7LZX.15.34.D01.1.454.light.4.raw
tctacgtagccacgaccggtgctcgatttagatcgtctgtgttgggtttggggggaaggcctgagaacacttagccttcatgagtgtccccacccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtccttttatgtggggcgtggcatttgggtgttcggcggagggaccaaactgaccgtcctaggtcagcccaaggctgccccctcggtcact

SEQ ID NO: 579269 - DNA, 501 bp, Homo sapiens; identical to SEQ ID NO: 536142
  misc_feature: HIJSMM301DV2LG.15.1.A01.1.454.light.4.raw

SEQ ID NO: 579270 - DNA, 480 bp, Homo sapiens
  misc_feature: HIJSMM301DXNDR.48.1.A01.1.454.light.4.raw
agtatacatacacgaccggtgctcgatttagacgtctcatcagggcaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccgcctctcgtagtatagttataactctcgtagcgggcggtcggtcggaacggacggcgactagtag

SEQ ID NO: 579271 - DNA, 438 bp, Homo sapiens
  misc_feature: HIJSMM301BT5Z7.52.87.H10.1.454.light.4.raw
cgcagtacgacacgaccggtgctcgatttagcagtactgcgttgggtttgggggtctgcggcctcccatgacctgactcagtcactctcagtgtcggtggccctgggacagacggccactattacctgtgggggatacaacattggaactaaaaatgtgcagtggtaccagcagaagccaggccaggcccctgtgttggtcatctatagggatcgaagacgggcctctgggattcctgagcgattctctggctccaactcggagaacacggccaccctgaccatcagaagtgcccaagtcggtgatgaggcagactattactgccaggtgtgggacagtggtgttgtgatattcggcggagggaccaagctgaccgtcctaagtcagcccaaggctgccccctcggtcactctgttcccgccctcctctatacgatcg

SEQ ID NO: 579272 - DNA, 488 bp, Homo sapiens; identical to SEQ ID NO: 535990
  misc_feature: HIJSMM301CLNPU.11.28.C06.1.454.light.4.raw

SEQ ID NO: 579273 - DNA, 484 bp, Homo sapiens; identical to SEQ ID NO: 535400
  misc_feature: HIJSMM301B2TO0.46.26.C04.1.454.light.4.raw

SEQ ID NO: 579274 - DNA, 502 bp, Homo sapiens
  misc_feature: HIJSMM301AZ644.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccgaacggtggaacgtacaaacgaaactagtggctg

SEQ ID NO: 579275 - DNA, 480 bp, Homo sapiens
  misc_feature: HIJSMM301BVW0S.5.39.D06.1.454.light.4.raw
  modified_base (402)..(402): a, c, t, g, unknown or other
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttnttactgccaacaatataatagttattggacgttcggccaggggacgaaggtcgaaatgagacgaactgtggctgcacc

SEQ ID NO: 579276 - DNA, 505 bp, Homo sapiens
  misc_feature: HIJSMM301ER7IA.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattatactgcagctcatatacaagcagcagcactcaagtcttcggaactgggaccaaggtcaccgtcctaggtcagcccaaggccaaccccactgtca

SEQ ID NO: 579277 - DNA, 497 bp, Homo sapiens
  misc_feature: HIJSMM301AZ7F6.51.84.H07.1.454.light.4.raw
cgatcgtatacacgaccggtgctcgatttagcagacgtctgtcgcggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatacaaacgaactagtggctgcaccatctgtcttcatt

SEQ ID NO: 579278 - DNA, 505 bp, Homo sapiens; identical to SEQ ID NO: 539292
  misc_feature: HIJSMM301BI9IY.19.85.H08.1.454.light.4.raw

SEQ ID NO: 579279 - DNA, 498 bp, Homo sapiens; identical to SEQ ID NO: 535295
  misc_feature: HIJSMM301AXTSZ.15.25.C03.1.454.light.4.raw

SEQ ID NO: 579280 - DNA, 480 bp, Homo sapiens
  misc_feature: HIJSMM301B4H06.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttactttgtcaacaggctcagagtttcccgcttcacttttcggcggagggaccaaggtggagatcaaacgaactgtggctgca

SEQ ID NO: 579281 - DNA, 484 bp, Homo sapiens
  misc_feature: HIJSMM301C4BP1.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactgtggctgcaccaatctgtcttcta

SEQ ID NO: 579282 - DNA, 488 bp, Homo sapiens
  misc_feature: HIJSMM301AHPOE.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacaccttttggccaggggaccaaactggacatcaaacgaactgtggctgcaccatctgt

SEQ ID NO: 579283 - DNA, 496 bp, Homo sapiens
  misc_feature: HIJSMM301C821C.52.55.E11.1.454.light.4.raw
cgcagtacgacacgaccggtgctcgatttagcactcgcacgttgggtttgggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggaggaccaaggttgagatcaaacgaactgtggctgcaccatctgtcttcatcttcccg

SEQ ID NO: 579284 - DNA, 495 bp, Homo sapiens; identical to SEQ ID NO: 569736
  misc_feature: HIJSMM301DYGRJ.13.39.D06.1.454.light.4.raw

SEQ ID NO: 579285 - DNA, 479 bp, Homo sapiens; identical to SEQ ID NO: 542895
  misc_feature: HIJSMM301ERBMA.40.59.F04.1.454.light.4.raw

SEQ ID NO: 579286 - DNA, 493 bp, Homo sapiens
  misc_feature: HIJSMM301DKT79.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcgaggggtccctgaccgattctccggctccaagtctggcacatcagcctccctggccatcactgggctcaggctgaggatgaggctgactattactgccagtcgtatgacagtggcctaagtaacatcgtcttcggaactgggaccaaggtcaccgtccg

SEQ ID NO: 579287 - DNA, 508 bp, Homo sapiens
  misc_feature: HIJSMM301B0CS8.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccgggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctc

SEQ ID NO: 579288 - DNA, 447 bp, Homo sapiens; identical to SEQ ID NO: 535882
  misc_feature: HIJSMM301AJF34.18.9.A09.1.454.light.4.raw
  modified_base (429)..(429): a, c, t, g, unknown or other

SEQ ID NO: 579289 - DNA, 503 bp, Homo sapiens; identical to SEQ ID NO: 538884
  misc_feature: HIJSMM301EO71V.27.78.H01.1.454.light.4.raw

SEQ ID NO: 579290 - DNA, 501 bp, Homo sapiens
  misc_feature: HIJSMM301CKFI9.40.33.C11.1.454.light.4.raw
tctagcgactcacgaccggtgctcgatttagagtgagctcgttgggtttgggcacgaccggtgctcgatttagagtgagctcgttgggtttggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccat

SEQ ID NO: 579291 - DNA, 509 bp, Homo sapiens; identical to SEQ ID NO: 547637
  misc_feature: HIJSMM301ANELX.9.33.C11.1.454.light.4.raw

SEQ ID NO: 579292 - DNA, 502 bp, Homo sapiens; identical to SEQ ID NO: 577412
  misc_feature: HIJSMM301A9LL4.5.86.H09.1.454.light.4.raw

SEQ ID NO: 579293 - DNA, 488 bp, Homo sapiens
  misc_feature: HIJSMM301ELOGP.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcgccaagggacacgactggagattaaacgaactgtggctgcaccatctgtcttcat

SEQ ID NO: 579294 - DNA, 484 bp, Homo sapiens; identical to SEQ ID NO: 536162
  misc_feature: HIJSMM301CBQ7T.13.59.F04.1.454.light.4.raw

SEQ ID NO: 579295 - DNA, 486 bp, Homo sapiens; identical to SEQ ID NO: 535043
  misc_feature: HIJSMM301AKKOG.46.35.D02.1.454.light.4.raw

SEQ ID NO: 579296 - DNA, 499 bp, Homo sapiens
  misc_feature: HIJSMM301CFVZN.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaaggtgaccgtcctacgtcagcccaaggctgccccctcggtcactctccg

SEQ ID NO: 579297 - DNA, 492 bp, Homo sapiens; identical to SEQ ID NO: 539019
  misc_feature: HIJSMM301BUBS5.9.1.A01.1.454.light.4.raw

SEQ ID NO: 579298 - DNA, 506 bp, Homo sapiens; identical to SEQ ID NO: 538849
  misc_feature: HIJSMM301C64SW.43.15.B04.1.454.light.4.raw

SEQ ID NO: 579299 - DNA, 517 bp, Homo sapiens; identical to SEQ ID NO: 557301
  misc_feature: HIJSMM301ATN7R.19.80.H03.1.454.light.4.raw

SEQ ID NO: 579300 - DNA, 445 bp, Homo sapiens; identical to SEQ ID NO: 542143
  misc_feature: HIJSMM301DMGUP.47.85.H08.1.454.light.4.raw

SEQ ID NO: 579301 - DNA, 434 bp, Homo sapiens; identical to SEQ ID NO: 535153
  misc_feature: HIJSMM301BGPLY.18.5.A05.1.454.light.4.raw

SEQ ID NO: 579302 - DNA, 510 bp, Homo sapiens; identical to SEQ ID NO: 553863
  misc_feature: HIJSMM301C6153.16.46.E02.1.454.light.4.raw

SEQ ID NO: 579303 - DNA, 503 bp, Homo sapiens
  misc_feature: HIJSMM301DS3G5.40.26.C04.1.454.light.4.raw
tctagcgactcacgaccggtgctcgatttagtctagcgactttgggtttgggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 579304 - DNA, 486 bp, Homo sapiens
  misc_feature: HIJSMM301COSW3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaaggacttttggccaggggaccaagctggagatcaaacgaactgtggctgcaccat

SEQ ID NO: 579305 - DNA, 483 bp, Homo sapiens; identical to SEQ ID NO: 539848
  misc_feature: HIJSMM301ATSY1.46.26.C04.1.454.light.4.raw

SEQ ID NO: 579306 - DNA, 504 bp, Homo sapiens
  misc_feature: HIJSMM301D65OY.3.33.C11.1.454.light.4.raw
agacgcactccacgaccggtgctcgatttagagtgagctcgttgggtttggggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggcctgccccctcggtccactcctcgttcccgccctcctcgagtgcgtctctc

SEQ ID NO: 579307 - DNA, 477 bp, Homo sapiens
  misc_feature: HIJSMM301A26E4.5.15.B04.1.454.light.4.raw
atcagacacgcacgaccggtgctcgatttagacagtatatatccgcggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactagtggctgcacca

SEQ ID NO: 579308 - DNA, 488 bp, Homo sapiens
  misc_feature: HIJSMM301BVTVY.48.73.G07.1.454.light.4.raw
agtatacatacacgaccggtgctcgatttagctctacgctcagggcacgaccggtgctcgatttagtgacatctcgcagttctttgggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgcat

SEQ ID NO: 579309 - DNA, 508 bp, Homo sapiens
  misc_feature: HIJSMM301BVBQU.51.49.E05.1.454.light.4.raw
cgatcgtatacacgaccggtgctcgatttagagcgactagcaacacacaagggggtgggctcagaagcagagttctggggtgtctccaccatggcctggacccctctctggctcactctcctcactctttgcataggttctgtggtttcctctgagctgactcaggaccccgctgtatctgtggccttgggacagacagtcaggatcacatgccaaggagacagcctcacaagttattatgcaggctggtaccagcagaagccaggacaagcccctatacttgtcctctatggtaataatcaccggccctcagggatcccagaccgattctctggctccagctcaggaaacacagcttccttgaccatcactggggctcaggcggaagatgaggctgactactactgtaattcccgggacaccagtggtcatagtggaaaccgggtcgtgttcggcggagggaccaaggtgaccgtcctgggtcagcccaaggctgccccctcggtca

SEQ ID NO: 579310 - DNA, 508 bp, Homo sapiens; identical to SEQ ID NO: 536388
  misc_feature: HIJSMM301BS3WF.11.57.F02.1.454.light.4.raw

SEQ ID NO: 579311 - DNA, 487 bp, Homo sapiens
  misc_feature: HIJSMM301B6JAF.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgctggctgaagatgtggcagtttattattgtcaacaatattattatacttcgtggacgttcggccaagggaccgaaggtggatatcagacgaa

SEQ ID NO: 579312 - DNA, 491 bp, Homo sapiens; identical to SEQ ID NO: 545038
  misc_feature: HIJSMM301CX4XS.22.25.C03.1.454.light.4.raw

SEQ ID NO: 579313 - DNA, 454 bp, Homo sapiens; identical to SEQ ID NO: 534964
  misc_feature: HIJSMM301B09T2.19.86.H09.1.454.light.4.raw

SEQ ID NO: 579314 - DNA, 495 bp, Homo sapiens
  misc_feature: HIJSMM301C5SL6.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaaacaccttcggccaaggacacgactggagattaaaggaaactgtggctgcaccatctgtcttcatcttccccg

SEQ ID NO: 579315 - DNA, 512 bp, Homo sapiens
  misc_feature: HIJSMM301B1BXW.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccgggatgaggccgactattattgtcaggtgtgggatagtagtagtgatcatgtggtattcggcggagggaccaagctgaccgtccttggtcagcccaaggctgccccctcggtcactctgttcccacct

SEQ ID NO: 579316 - DNA, 472 bp, Homo sapiens
  misc_feature: HIJSMM301BH6FM.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccacgggaccaaagtggatatcaaacgaactgtggctgcaccatctgtcttcatcttccgccat

SEQ ID NO: 579317 - DNA, 488 bp, Homo sapiens; identical to SEQ ID NO: 537260
  misc_feature: HIJSMM301BVV0X.47.70.G04.1.454.light.4.raw

SEQ ID NO: 579318 - DNA, 509 bp, Homo sapiens; identical to SEQ ID NO: 539359
  misc_feature: HIJSMM301AF9O8.47.85.H08.1.454.light.4.raw

SEQ ID NO: 579319 - DNA, 484 bp, Homo sapiens
  misc_feature: HIJSMM301DEL5D.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcaggtgggtctgggacagagttcactctcaccatcagcagcctgcagtctgatgatgttgcagtttattactgtcatcaatatggtgaccggcccacgttcggccaagggaccaaggtggaaatcaaacgaactgtggctgcaccatctgtctt

SEQ ID NO: 579320 - DNA, 482 bp, Homo sapiens; identical to SEQ ID NO: 539800
  misc_feature: HIJSMM301EMXVG.21.25.C03.1.454.light.4.raw

SEQ ID NO: 579321 - DNA, 502 bp, Homo sapiens; identical to SEQ ID NO: 536930
  misc_feature: HIJSMM301DD724.41.45.E01.1.454.light.4.raw

SEQ ID NO: 579322 - DNA, 504 bp, Homo sapiens; identical to SEQ ID NO: 562026
  misc_feature: HIJSMM301DJSCX.9.71.G05.1.454.light.4.raw

SEQ ID NO: 579323 - DNA, 495 bp, Homo sapiens; identical to SEQ ID NO: 542571
  misc_feature: HIJSMM301C79TV.7.59.F04.1.454.light.4.raw

SEQ ID NO: 579324 - DNA, 484 bp, Homo sapiens
  misc_feature: HIJSMM301CUALD.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagcccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaggacacgactggagattaaggaaactgtggctgcaccatctgtcttc

SEQ ID NO: 579325 - DNA, 492 bp, Homo sapiens; identical to SEQ ID NO: 536010
  misc_feature: HIJSMM301EQZJG.10.20.B09.1.454.light.4.raw

SEQ ID NO: 579326 - DNA, 514 bp, Homo sapiens; identical to SEQ ID NO: 546238
  misc_feature: HIJSMM301DKZVE.47.85.H08.1.454.light.4.raw

SEQ ID NO: 579327 - DNA, 507 bp, Homo sapiens
  misc_feature: HIJSMM301BKG92.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccaccctcc

SEQ ID NO: 579328 - DNA, 495 bp, Homo sapiens; identical to SEQ ID NO: 542410
  misc_feature: HIJSMM301B3781.26.12.B01.1.454.light.4.raw

SEQ ID NO: 579329 - DNA, 494 bp, Homo sapiens; identical to SEQ ID NO: 534992
  misc_feature: HIJSMM301BFOGX.9.1.A01.1.454.light.4.raw

SEQ ID NO: 579330 - DNA, 511 bp, Homo sapiens
  misc_feature: HIJSMM301B5FOZ.11.67.G01.1.454.light.4.raw
  modified_base (508)..(508): a, c, t, g, unknown or other
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctggtggtcttcgggcgggacgggaccaagctgaccgtccgtgggtcagcccaggctcgccccctcggtcnctc

SEQ ID NO: 579331 - DNA, 500 bp, Homo sapiens; identical to SEQ ID NO: 546613
  misc_feature: HIJSMM301CSALB.11.21.B10.1.454.light.4.raw

SEQ ID NO: 579332 - DNA, 499 bp, Homo sapiens
  misc_feature: HIJSMM301BB5I5.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacacagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggtccaagggaccgaaggtggaaggtcaaacgaactagtggctgcaccatctgtcttcatcttcccgt

SEQ ID NO: 579333 - DNA, 467 bp, Homo sapiens
  misc_feature: HIJSMM301AYNK1.52.19.B08.1.454.light.4.raw
cgcagtacgacacgaccggtgctcgatttagtgagtcagtaagggggcaggagtcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggtaccgaaggtggagatcaagcgaa

SEQ ID NO: 579334 - DNA, 512 bp, Homo sapiens
  misc_feature: HIJSMM301EGEAI.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaacccactgtcactctgttcccaccct

SEQ ID NO: 579335 - DNA, 502 bp, Homo sapiens
  misc_feature: HIJSMM301EZUJW.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggcctggaccaaagtggatatcaaacgaactagtggctgcaccatctgtt

SEQ ID NO: 579336 - DNA, 495 bp, Homo sapiens; identical to SEQ ID NO: 536931
  misc_feature: HIJSMM301CF6XB.10.33.C11.1.454.light.4.raw

SEQ ID NO: 579337 - DNA, 486 bp, Homo sapiens
  misc_feature: HIJSMM301EPKC5.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggccaaagttgagatcaaacgaactgtggctgcaccatctgtt

SEQ ID NO: 579338 - DNA, 495 bp, Homo sapiens
  misc_feature: HIJSMM301DG1R7.27.78.H01.1.454.light.4.raw
  modified_base (465)..(465): a, c, t, g, unknown or other
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgganattaaacgaactgtggctgcaccatctgtt

SEQ ID NO: 579339 - DNA, 495 bp, Homo sapiens
  misc_feature: HIJSMM301CLB7T.21.38.D05.1.454.light.4.raw
tcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctaggccaggctcccagtctcctcatctatgggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccgaaggtggagatcagacgaactgttggctgcacccatctgtcttc

SEQ ID NO: 579340 - DNA, 506 bp, Homo sapiens; identical to SEQ ID NO: 537290
  misc_feature: HIJSMM301CG5TG.13.11.A11.1.454.light.4.raw

SEQ ID NO: 579341 - DNA, 503 bp, Homo sapiens; identical to SEQ ID NO: 537216
  misc_feature: HIJSMM301DMVCP.3.70.G04.1.454.light.4.raw

SEQ ID NO: 579342 - DNA, 483 bp, Homo sapiens
  misc_feature: HIJSMM301APDFR.46.26.C04.1.454.light.4.raw
  modified_base (445)..(445): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgntcactttcggcggagggaccaaggtggagatcaacgaa

SEQ ID NO: 579343 - DNA, 479 bp, Homo sapiens; identical to SEQ ID NO: 537163
  misc_feature: HIJSMM301CRB8Q.13.73.G07.1.454.light.4.raw

SEQ ID NO: 579344 - DNA, 496 bp, Homo sapiens
  misc_feature: HIJSMM301B8187.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccaggggtggagatcaaacgaactgtggctgcaccatctgtcttcattcc

SEQ ID NO: 579345 - DNA, 485 bp, Homo sapiens
  misc_feature: HIJSMM301EOXXZ.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaaactaacgaactgtggctgcaccta

SEQ ID NO: 579346 - DNA, 520 bp, Homo sapiens; identical to SEQ ID NO: 541666
  misc_feature: HIJSMM301CKV2H.41.19.B08.1.454.light.4.raw

SEQ ID NO: 579347 - DNA, 490 bp, Homo sapiens
  misc_feature: HIJSMM301EOQIJ.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgttcttcggaaactgggacccacgttaccgtcctaggtcagaccccg

SEQ ID NO: 579348 - DNA, 499 bp, Homo sapiens; identical to SEQ ID NO: 543922
  misc_feature: HIJSMM301A1IZG.18.11.A11.1.454.light.4.raw

SEQ ID NO: 579349 - DNA, 490 bp, Homo sapiens; identical to SEQ ID NO: 535234
  misc_feature: HIJSMM301CS1VC.17.21.B10.1.454.light.4.raw

SEQ ID NO: 579350 - DNA, 511 bp, Homo sapiens
  misc_feature: HIJSMM301ARM9E.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttcccgt

SEQ ID NO: 579351 - DNA, 489 bp, Homo sapiens; identical to SEQ ID NO: 535139
  misc_feature: HIJSMM301A1TON.14.55.E11.1.454.light.4.raw

SEQ ID NO: 579352 - DNA, 496 bp, Homo sapiens
  misc_feature: HIJSMM301E1EYT.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtgtaaatcaaacgaactgtggctgcacc

SEQ ID NO: 579353 - DNA, 482 bp, Homo sapiens
  misc_feature: HIJSMM301EHU7F.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcgggtagggaccaagctgaccgtcctacgtcagccaaggctgccccctc

SEQ ID NO: 579354 - DNA, 442 bp, Homo sapiens
  misc_feature: HIJSMM301C77E0.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtctacgtcagcccaaggctgccccctcggtcactctgttcccgcctcctcgacacgcgag

SEQ ID NO: 579355 - DNA, 529 bp, Homo sapiens
  misc_feature: HIJSMM301DO4XD.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccccggacgttcggtccaacgggaccgaacggtagggaaacgtaacgtaacgacgaaaccgtagtcgggcgtggcaccaactctcgtctttctacttt

SEQ ID NO: 579356 - DNA, 487 bp, Homo sapiens
  misc_feature: HIJSMM301CL93B.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagatttggaacttattattgtcaacagggtaacagtttcccgctcaccttcggcggagggaccaaggtggagatgaaagaactgtggctgcaccat

SEQ ID NO: 579357 - DNA, 505 bp, Homo sapiens
  misc_feature: HIJSMM301DM6V1.53.71.G05.1.454.light.4.raw
cgcgtatacacacgaccggtgctcgatttagtgtcgtcgcaagagagaggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctgtt

SEQ ID NO: 579358 - DNA, 490 bp, Homo sapiens
  misc_feature: HIJSMM301ERFHE.49.55.E11.1.454.light.4.raw
agtcgagagacacgaccggtgctcgatttagcactcgcacgttgggtttggggggaactgctcagttaggacccagacggaaccatggaagctccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccgggacactttcggtcggagggaccaaggtggagatcaaacgaactgtggctggcaccat

SEQ ID NO: 579359 - DNA, 495 bp, Homo sapiens
  misc_feature: HIJSMM301CJVOS.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagtattcttcttaccctcggacgttcggtccgacgggaccgaccggtggagtgtcaagcgaacgtgtggcgtgcaccatcttcg

SEQ ID NO: 579360 - DNA, 514 bp, Homo sapiens
  misc_feature: HIJSMM301CPEVK.40.12.B01.1.454.light.4.raw
tctagcgactcacgaccggtgctcgatttagtagtgtagattccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaaggctgaccgtcctaggtcagcccaaggctgccccctcggtcactctgttcccg

SEQ ID NO: 579361 - DNA, 507 bp, Homo sapiens
  misc_feature: HIJSMM301DDK2R.49.14.B03.1.454.light.4.raw
agtcgagagacacgaccggtgctcgatttagtgtgagtagttccgcgggcacgaccggtgctcgatttagagagagtgtgttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagccctcccaggctcctcatctatgatacatccaacagggccactggcatcccagccaggttcagtggcaggtgggtctgggacagacttcactctcaccatcagcagcctagagcctgaagtatttgcagtctattactgtcagcagcgttacaactggcctcccatgtactacttttggccgagggaccgaagcta

SEQ ID NO: 579362 - DNA, 481 bp, Homo sapiens
  misc_feature: HIJSMM301A8XSJ.16.86.H09.1.454.light.4.raw
tgtactactccacgaccggtgctcgatttagtgctatagacttgggtttgggggggggtctcaggaggcagcgctctcaggacatctccaccatggcctgggctctcgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcgggcggagggaccaagctgaccgtcctaggtcagcccaaggctgccccctcggtcactctgttcccgccctcctcgagtagtaca

SEQ ID NO: 579363 - DNA, 501 bp, Homo sapiens
  misc_feature: HIJSMM301DA2VL.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagcccg

SEQ ID NO: 579364 - DNA, 520 bp, Homo sapiens; identical to SEQ ID NO: 539176
  misc_feature: HIJSMM301C09KE.27.23.C01.1.454.light.4.raw

SEQ ID NO: 579365 - DNA, 458 bp, Homo sapiens
  misc_feature: HIJSMM301B99X1.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctccggtcactctgtttcccgccctcctccaccgagaggta

SEQ ID NO: 579366 - DNA, 478 bp, Homo sapiens
  misc_feature: HIJSMM301DA575.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacacacctgcgtggttttggctgttcggcgcgggacc

SEQ ID NO: 579367 - DNA, 520 bp, Homo sapiens
  misc_feature: HIJSMM301BS5MB.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgttcccaccct

SEQ ID NO: 579368 - DNA, 485 bp, Homo sapiens; identical to SEQ ID NO: 539536
  misc_feature: HIJSMM301BOC4D.48.38.D05.1.454.light.4.raw

SEQ ID NO: 579369 - DNA, 476 bp, Homo sapiens; identical to SEQ ID NO: 541471
  misc_feature: HIJSMM301ETK2T.13.4.A04.1.454.light.4.raw

SEQ ID NO: 579370 - DNA, 506 bp, Homo sapiens
  misc_feature: HIJSMM301CLMZ3.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggccaagctgaccgtcctaggtcagcccaaggctgccccccg

SEQ ID NO: 579371 - DNA, 505 bp, Homo sapiens
  misc_feature: HIJSMM301BCSYE.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtgctgcaccatctgtt

SEQ ID NO: 579372 - DNA, 521 bp, Homo sapiens; identical to SEQ ID NO: 538715
  misc_feature: HIJSMM301EB0RR.27.23.C01.1.454.light.4.raw

SEQ ID NO: 579373 - DNA, 508 bp, Homo sapiens; identical to SEQ ID NO: 536388
  misc_feature: HIJSMM301A7YQY.11.57.F02.1.454.light.4.raw

SEQ ID NO: 579374 - DNA, 494 bp, Homo sapiens; identical to SEQ ID NO: 534994
  misc_feature: HIJSMM301AQ5H5.27.78.H01.1.454.light.4.raw

SEQ ID NO: 579375 - DNA, 509 bp, Homo sapiens; identical to SEQ ID NO: 540854
  misc_feature: HIJSMM301ELF1H.4.71.G05.1.454.light.4.raw

SEQ ID NO: 579376 - DNA, 471 bp, Homo sapiens
  misc_feature: HIJSMM301EP5PL.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccgaaggtggagatcaagcgaactgt

SEQ ID NO: 579377 - DNA, 446 bp, Homo sapiens
  misc_feature: HIJSMM301DBDQP.18.9.A09.1.454.light.4.raw
  modified_base (428)..(428): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagccaaggccaacccctctgtcactctgttcccnccctcctccatactcgta

SEQ ID NO: 579378 - DNA, 487 bp, Homo sapiens; identical to SEQ ID NO: 538190
  misc_feature: HIJSMM301ANIB7.47.70.G04.1.454.light.4.raw

SEQ ID NO: 579379 - DNA, 493 bp, Homo sapiens; identical to SEQ ID NO: 539015
  misc_feature: HIJSMM301CIGSS.27.78.H01.1.454.light.4.raw

SEQ ID NO: 579380 - DNA, 505 bp, Homo sapiens; identical to SEQ ID NO: 536233
  misc_feature: HIJSMM301DBWNC.48.25.C03.1.454.light.4.raw

SEQ ID NO: 579381 - DNA, 514 bp, Homo sapiens; identical to SEQ ID NO: 545978
  misc_feature: HIJSMM301ARRQW.17.33.C11.1.454.light.4.raw

SEQ ID NO: 579382 - DNA, 444 bp, Homo sapiens; identical to SEQ ID NO: 534993
  misc_feature: HIJSMM301CALZ3.5.9.A09.1.454.light.4.raw

SEQ ID NO: 579383 - DNA, 495 bp, Homo sapiens
  misc_feature: HIJSMM301ASEMD.13.11.A11.1.454.light.4.raw
tcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctgttctccg

SEQ ID NO: 579384 - DNA, 486 bp, Homo sapiens
  misc_feature: HIJSMM301EXTNG.10.59.F04.1.454.light.4.raw
  modified_base (455)..(455): a, c, t, g, unknown or other
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttggtgttcggcggngggacagctgaccgtcctaggtcagaccccg

SEQ ID NO: 579385 - DNA, 501 bp, Homo sapiens; identical to SEQ ID NO: 555551
  misc_feature: HIJSMM301BV2XJ.21.81.H04.1.454.light.4.raw

SEQ ID NO: 579386 - DNA, 519 bp, Homo sapiens; identical to SEQ ID NO: 548902
  misc_feature: HIJSMM301EKN1J.27.23.C01.1.454.light.4.raw

SEQ ID NO: 579387 - DNA, 496 bp, Homo sapiens
  misc_feature: HIJSMM301B1Z2M.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatctttcccg

SEQ ID NO: 579388 - DNA, 494 bp, Homo sapiens
  misc_feature: HIJSMM301D0I8N.52.35.D02.1.454.light.4.raw
cgcagtacgacacgaccggtgctcgatttagcacacgatagttgggtttgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 579389 - DNA, 496 bp, Homo sapiens; identical to SEQ ID NO: 535109
  misc_feature: HIJSMM301CAUDB.16.78.H01.1.454.light.4.raw

SEQ ID NO: 579390 - DNA, 511 bp, Homo sapiens
  misc_feature: HIJSMM301CEU93.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggcctaagggaccgaaggtaggaaagtacaaacgaacctagtggctgcaccactctgtcttcatcttccccg

SEQ ID NO: 579391 - DNA, 444 bp, Homo sapiens
  misc_feature: HIJSMM301DXXQ9.2.76.G10.1.454.light.4.raw
acgctcgacacacgaccggtgctcgatttagtcactcatacagggtcctggacccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtcgagcgt

SEQ ID NO: 579392 - DNA, 496 bp, Homo sapiens; identical to SEQ ID NO: 541772
  misc_feature: HIJSMM301BPSZT.51.81.H04.1.454.light.4.raw

SEQ ID NO: 579393 - DNA, 501 bp, Homo sapiens; identical to SEQ ID NO: 556869
  misc_feature: HIJSMM301AY8TJ.21.81.H04.1.454.light.4.raw

SEQ ID NO: 579394 - DNA, 487 bp, Homo sapiens; identical to SEQ ID NO: 536272
  misc_feature: HIJSMM301DXTHR.17.25.C03.1.454.light.4.raw

SEQ ID NO: 579395 - DNA, 478 bp, Homo sapiens; identical to SEQ ID NO: 540986
  misc_feature: HIJSMM301C6FJQ.16.86.H09.1.454.light.4.raw

SEQ ID NO: 579396 - DNA, 494 bp, Homo sapiens
  misc_feature: HIJSMM301AU27E.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccgaacgggacgacactggagaattaaacgaactgtggctgcaccact

SEQ ID NO: 579397 - DNA, 483 bp, Homo sapiens
  misc_feature: HIJSMM301EAHPT.43.36.D03.1.454.light.4.raw
tgtgagtagtcacgaccggtgctcgatttagctgcgtcacgatctctcttggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatcccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacatattttagtgctccgtacacttttggccaggggaccaagttggagatcaaacgaa

SEQ ID NO: 579398 - DNA, 492 bp, Homo sapiens; identical to SEQ ID NO: 535335
  misc_feature: HIJSMM301CPZUZ.16.53.E09.1.454.light.4.raw

SEQ ID NO: 579399 - DNA, 514 bp, Homo sapiens; identical to SEQ ID NO: 538541
  misc_feature: HIJSMM301A6CV2.47.23.C01.1.454.light.4.raw

SEQ ID NO: 579400 - DNA, 416 bp, Homo sapiens; identical to SEQ ID NO: 536892
  misc_feature: HIJSMM301AXI7A.16.46.E02.1.454.light.4.raw

SEQ ID NO: 579401 - DNA, 494 bp, Homo sapiens; identical to SEQ ID NO: 535184
  misc_feature: HIJSMM301DVZGV.16.71.G05.1.454.light.4.raw

SEQ ID NO: 579402 - DNA, 496 bp, Homo sapiens
  misc_feature: HIJSMM301EE2OR.19.71.G05.1.454.light.4.raw
  modified_base (416)..(416): a, c, t, g, unknown or other
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctaaccgattcagtggcagcgggtctgggacagatttcactctcaccatcagcagcctgcaggctgaagatgtggcagtttntattgtcaacaatattattatacttcgtggacgttcggccaagggaccaaggtggatatcggacgaactgtggctgcacc

SEQ ID NO: 579403 - DNA, 504 bp, Homo sapiens; identical to SEQ ID NO: 535561
  misc_feature: HIJSMM301B9ACC.4.57.F02.1.454.light.4.raw

SEQ ID NO: 579404 - DNA, 496 bp, Homo sapiens
  misc_feature: HIJSMM301EEP97.27.78.H01.1.454.light.4.raw
  modified_base (483)..(483): a, c, t, g, unknown or other
  modified_base (490)..(490): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtacaccatcacctgccgggccgagtcagagcgttggtagtagcttacactggtaccagcagaagccaggtcagtctccaaagctcctcatcaagtatgcttcccagtccttctcaggggtcccctccgaggttcagtggcagtggatctgggacacatttcaccctcaccatcaatagcctggaagctgaagatgctgcaacttattactgtcatcagagtactactttacctcaagtgatcaccttcggccaagggacacactggagattaaacgaactgtggctncaccatntgtctt

SEQ ID NO: 579405 - DNA, 519 bp, Homo sapiens
  misc_feature: HIJSMM301AVBIF.41.55.E11.1.454.light.4.raw
tctatactatcacgaccggtgctcgatttagcactcgcacgttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccacctcctca

SEQ ID NO: 579406 - DNA, 504 bp, Homo sapiens
  misc_feature: HIJSMM301DC525.19.71.G05.1.454.light.4.raw
tactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtcggtccgaacggaccgaacgtagggagtaattcagacgaactagtggcgt

SEQ ID NO: 579407 - DNA, 512 bp, Homo sapiens
  misc_feature: HIJSMM301DHE8L.51.53.E09.1.454.light.4.raw
cgatcgtatacacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactc

SEQ ID NO: 579408 - DNA, 494 bp, Homo sapiens; identical to SEQ ID NO: 534994
  misc_feature: HIJSMM301DW9DX.27.78.H01.1.454.light.4.raw

SEQ ID NO: 579409 - DNA, 497 bp, Homo sapiens; identical to SEQ ID NO: 535286
  misc_feature: HIJSMM301BBV1R.18.59.F04.1.454.light.4.raw

SEQ ID NO: 579410 - DNA, 453 bp, Homo sapiens
  misc_feature: HIJSMM301AZ1L0.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtcctaggtcagcccaaggccaaccccactgtcactctgttcccaccctcctccatactcgta

SEQ ID NO: 579411 - DNA, 500 bp, Homo sapiens
  misc_feature: HIJSMM301ETMSF.41.67.G01.1.454.light.4.raw
tctatactatcacgaccggtgctcgatttagagtatacatattgggtttgggggagtcagacccagtcaggacacagcatggacatgagggtccccgctcagctcctggggctcctgctgctctggctcccaggtgcgaaatgtgacatccagatgacccagtctccttccaccctgtctgcatttgtagtagacagagtcaccatcacttgccgggccagtcagagtcttagtaattggttggcctgctatcagcggaaaccggggaaagaccgtaacctcctcatgtctaacccatccactttagaaactggggccccatcaaggttcagcggccgtggatctgggacagaattcactctcaccatcagcagcctgcagcctgagaattttgcaaattgtcactaccaacagtttagtcttattcatattcggcggagggaccagggtcgaggtcaaacgaactgtggctgcaccatctgtcttcatcttcccgccat

SEQ ID NO: 579412 - DNA, 463 bp, Homo sapiens; identical to SEQ ID NO: 535008
  misc_feature: HIJSMM301EWEAW.10.9.A09.1.454.light.4.raw

SEQ ID NO: 579413 - DNA, 485 bp, Homo sapiens
  misc_feature: HIJSMM301B5JVS.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacggactggagattaaacgaactgtgctgcacca

SEQ ID NO: 579414 - DNA, 475 bp, Homo sapiens
  misc_feature: HIJSMM301CGOE9.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtgctgca

SEQ ID NO: 579415 - DNA, 484 bp, Homo sapiens; identical to SEQ ID NO: 576854
  misc_feature: HIJSMM301AD902.52.23.C01.1.454.light.4.raw

SEQ ID NO: 579416 - DNA, 508 bp, Homo sapiens
  misc_feature: HIJSMM301B4MVD.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccac

SEQ ID NO: 579417 - DNA, 504 bp, Homo sapiens
  misc_feature: HIJSMM301CQR3L.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctcggggtccctgacagttcgagtggcagtggatcaggcacagattttactactgaaaatacagcagagtggaggcgtgaggagtgttgggtcgtctattattgtcatgcaagactctactaacgtccgcctcacttcgtcggacgggacggacggaggtaggagtataacgaaactaacg

SEQ ID NO: 579418 - DNA, 494 bp, Homo sapiens; identical to SEQ ID NO: 534992
  misc_feature: HIJSMM301DJM2T.9.1.A01.1.454.light.4.raw

SEQ ID NO: 579419 - DNA, 484 bp, Homo sapiens; identical to SEQ ID NO: 540489
  misc_feature: HIJSMM301B9P0A.7.75.G09.1.454.light.4.raw

SEQ ID NO: 579420 - DNA, 514 bp, Homo sapiens; identical to SEQ ID NO: 545978
  misc_feature: HIJSMM301AGIW1.17.33.C11.1.454.light.4.raw

SEQ ID NO: 579421 - DNA, 506 bp, Homo sapiens; identical to SEQ ID NO: 534969
  misc_feature: HIJSMM301D34IS.18.37.D04.1.454.light.4.raw

SEQ ID NO: 579422 - DNA, 490 bp, Homo sapiens
  misc_feature: HIJSMM301C9KQT.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgtcgtcaggaccgaagtaggaagtacaacgaactagtggcgtgcaccatctgtctt

SEQ ID NO: 579423 - DNA, 497 bp, Homo sapiens; identical to SEQ ID NO: 535286
  misc_feature: HIJSMM301AKV79.18.59.F04.1.454.light.4.raw

SEQ ID NO: 579424 - DNA, 501 bp, Homo sapiens; identical to SEQ ID NO: 536142
  misc_feature: HIJSMM301B8QRA.15.1.A01.1.454.light.4.raw

SEQ ID NO: 579425 - DNA, 491 bp, Homo sapiens
  misc_feature: HIJSMM301D4XVW.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccaacagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactgtggctgcaccatctgtt

SEQ ID NO: 579426 - DNA, 502 bp, Homo sapiens; identical to SEQ ID NO: 543913
  misc_feature: HIJSMM301A0S3F.18.26.C04.1.454.light.4.raw

SEQ ID NO: 579427 - DNA, 503 bp, Homo sapiens
  misc_feature: HIJSMM301BJGMO.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcgaggtggaggctgaggatgttggggtttattacttgcatgcaaactcacacggccgctcactttcggcggagggaccaaggtggagatcaagaactgtgctgcaccatctgtt

SEQ ID NO: 579428 - DNA, 511 bp, Homo sapiens
  misc_feature: HIJSMM301BZRXZ.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctggtcactctgtt

SEQ ID NO: 579429 - DNA, 505 bp, Homo sapiens
  misc_feature: HIJSMM301EONJC.48.53.E09.1.454.light.4.raw
agtatacatacacgaccggtgctcgatttagagagagtgtgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaacgaactgtggctgcaccatctgtcttcatcttccccg

SEQ ID NO: 579430 - DNA, 509 bp, Homo sapiens; identical to SEQ ID NO: 553073
  misc_feature: HIJSMM301BCGEV.16.1.A01.1.454.light.4.raw

SEQ ID NO: 579431 - DNA, 495 bp, Homo sapiens
  misc_feature: HIJSMM301BPB1C.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaatacctactcttttctcttcggaactgggaccacggtcaccgtcctaggtcagcccaaggcccaaccca

SEQ ID NO: 579432 - DNA, 490 bp, Homo sapiens
  misc_feature: HIJSMM301BL2FC.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaagggaccgaacggtggaaagtacaaacgaactagtggctgcaccta

SEQ ID NO: 579433 - DNA, 484 bp, Homo sapiens; identical to SEQ ID NO: 544179
  misc_feature: HIJSMM301E1A3T.40.83.H06.1.454.light.4.raw

SEQ ID NO: 579434 - DNA, 503 bp, Homo sapiens; identical to SEQ ID NO: 537189
  misc_feature: HIJSMM301BSUEO.19.85.H08.1.454.light.4.raw

SEQ ID NO: 579435 - DNA, 478 bp, Homo sapiens; identical to SEQ ID NO: 541146
  misc_feature: HIJSMM301ALDPC.21.25.C03.1.454.light.4.raw

SEQ ID NO: 579436 - DNA, 506 bp, Homo sapiens; identical to SEQ ID NO: 554189
  misc_feature: HIJSMM301DKEYO.19.78.H01.1.454.light.4.raw

SEQ ID NO: 579437 - DNA, 494 bp, Homo sapiens; identical to SEQ ID NO: 534994
  misc_feature: HIJSMM301BY77T.27.78.H01.1.454.light.4.raw

SEQ ID NO: 579438 - DNA, 495 bp, Homo sapiens; identical to SEQ ID NO: 538651
  misc_feature: HIJSMM301DI8W8.10.79.H02.1.454.light.4.raw

SEQ ID NO: 579439 - DNA, 490 bp, Homo sapiens
  misc_feature: HIJSMM301DJ4IT.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacacctttcccctcactttcggcggagggaccaaggtggagatcaagcgaactgtggctgcaccatctgtctt

SEQ ID NO: 579440 - DNA, 444 bp, Homo sapiens; identical to SEQ ID NO: 535027
  misc_feature: HIJSMM301C1ZGW.8.73.G07.1.454.light.4.raw

SEQ ID NO: 579441 - DNA, 517 bp, Homo sapiens; identical to SEQ ID NO: 538938
  misc_feature: HIJSMM301DSGL7.7.86.H09.1.454.light.4.raw

SEQ ID NO: 579442 - DNA, 491 bp, Homo sapiens
  misc_feature: HIJSMM301EQWR4.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcatttc

SEQ ID NO: 579443 - DNA, 493 bp, Homo sapiens
  misc_feature: HIJSMM301CGXAQ.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtaccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatcttccccg

SEQ ID NO: 579444 - DNA, 465 bp, Homo sapiens; identical to SEQ ID NO: 538267
  misc_feature: HIJSMM301ATZS5.40.48.E04.1.454.light.4.raw

SEQ ID NO: 579445 - DNA, 500 bp, Homo sapiens
  misc_feature: HIJSMM301EHN1T.48.35.D02.1.454.light.4.raw
agtatacatacacgaccggtgctcgatttagcacacgatagttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtca

SEQ ID NO: 579446 - DNA, 504 bp, Homo sapiens
  misc_feature: HIJSMM301A3NR3.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggacggagggaccaaactgaccgtcctaggtccagcccaa

SEQ ID NO: 579447 - DNA, 494 bp, Homo sapiens; identical to SEQ ID NO: 540110
  misc_feature: HIJSMM301DDOIA.51.71.G05.1.454.light.4.raw

SEQ ID NO: 579448 - DNA, 495 bp, Homo sapiens
  misc_feature: HIJSMM301EADE8.51.7.A07.1.454.light.4.raw
cgatcgtatacacgaccggtgctcgatttagcacgtgtcgcaggggtccaaacagagcttcagcaagcatagtgggaatctgcaccatgccctgggctctgctcctcctgaccctcctcactcactctgcagtgtcagtggtcccggcaggactgacgcagccaccctcggtgtccaagggcttgagacagaccgccacactcacctgcattgggaactactacaatgtgggcgaccaaggaacactttggctgcagcagtaccagggccaccctcccaaactcctgtcctacagggataatacccggccctcagggatctcagagagattctcagcttccacgtcaggatacacagcctccctgaccattactggactccagcctgggacgaggctgactattactgctcagcgtgggacagcagcctcagagcttgggtgttcggcggagggaccaggctgaccgtcctgagtcagcccaaggctgccccccg

SEQ ID NO: 579449 - DNA, 499 bp, Homo sapiens
  misc_feature: HIJSMM301A3GAT.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccgaacggtaggaaagtactaaacgaaacctagtggtcgtcgcgaccctaa

SEQ ID NO: 579450 - DNA, 484 bp, Homo sapiens
  misc_feature: HIJSMM301CQBDL.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatggacaccggcctcagtgcgtggttttcggcggagggaccaagctgaccgtcctaggtcagaccccg

SEQ ID NO: 579451 - DNA, 490 bp, Homo sapiens; identical to SEQ ID NO: 535234
  misc_feature: HIJSMM301C2D8I.17.21.B10.1.454.light.4.raw

SEQ ID NO: 579452 - DNA, 506 bp, Homo sapiens; identical to SEQ ID NO: 543993
  misc_feature: HIJSMM301DIYQ0.18.78.H01.1.454.light.4.raw

SEQ ID NO: 579453 - DNA, 487 bp, Homo sapiens; identical to SEQ ID NO: 541729
  misc_feature: HIJSMM301DVO5B.40.83.H06.1.454.light.4.raw

SEQ ID NO: 579454 - DNA, 494 bp, Homo sapiens; identical to SEQ ID NO: 534994
  misc_feature: HIJSMM301AJ5JS.27.78.H01.1.454.light.4.raw

SEQ ID NO: 579455 - DNA, 493 bp, Homo sapiens; identical to SEQ ID NO: 536769
  misc_feature: HIJSMM301EHCCR.19.83.H06.1.454.light.4.raw

SEQ ID NO: 579456 - DNA, 495 bp, Homo sapiens
  misc_feature: HIJSMM301COJL7.11.59.F04.1.454.light.4.raw
  modified_base (412)..(412): a, c, t, g, unknown or other
  modified_base (464)..(464): a, c, t, g, unknown or other
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgcttgctcatatggaagtacctactcttttcncttcggaactgggaccacggtcaccgtcctaggtcagcccaaggccaacccnctgtcactctgttccccacctcctcgtatct

SEQ ID NO: 579457 - DNA, 505 bp, Homo sapiens; identical to SEQ ID NO: 539292
  misc_feature: HIJSMM301B5GW2.19.85.H08.1.454.light.4.raw

SEQ ID NO: 579458 - DNA, 497 bp, Homo sapiens; identical to SEQ ID NO: 536376
  misc_feature: HIJSMM301EYWZC.22.9.A09.1.454.light.4.raw

SEQ ID NO: 579459 - DNA, 531 bp, Homo sapiens
  misc_feature: HIJSMM301APZVW.7.71.G05.1.454.light.4.raw
cgtgtctctacacgaccggtgctcgatttagtgtcgtcgcaagagagagggggaggaactgctcagttaggacccagagggaaccatggaagccccacgctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatccccagccaggttcagtggcagtgggtctgggacagacttcactctcaccatcatcagcctggagcctgaagatgttgcagtttattactgtcaacatcgtaccgacgtggccgtcccgggggccgacctttcggtcccgtcgggtaccgaaacgtaggagtatactaaacgaaactacgtggcgtgtcgaccactactcgtcttt

SEQ ID NO: 579460 - DNA, 481 bp, Homo sapiens; identical to SEQ ID NO: 535993
  misc_feature: HIJSMM301CGVMY.21.25.C03.1.454.light.4.raw

SEQ ID NO: 579461 - DNA, 485 bp, Homo sapiens
  misc_feature: HIJSMM301AR7AN.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagagaa

SEQ ID NO: 579462 - DNA, 502 bp, Homo sapiens
  misc_feature: HIJSMM301A1HF3.40.60.F05.1.454.light.4.raw
tctagcgactcacgaccggtgctcgatttagtacgtcatcagggaaagggggagctgctcagttaggacccagagggaaccatggaaaccccagcgcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgtcggccaggacaacggtggacatcaagcgaactgtggctgcaccatctgtcttcactcttcccgtccact

SEQ ID NO: 579463 - DNA, 477 bp, Homo sapiens; identical to SEQ ID NO: 535506
  misc_feature: HIJSMM301BCPST.7.67.G01.1.454.light.4.raw

SEQ ID NO: 579464 - DNA, 401 bp, Homo sapiens
  misc_feature: HIJSMM301B7V72.8.53.E09.1.454.light.4.raw
ctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttccccaccctcctcgacacgcgag

SEQ ID NO: 579465 - DNA, 493 bp, Homo sapiens
  misc_feature: HIJSMM301DWB7F.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaacgtggacgatcaagcgaactgtggctgcaccatctgtt

SEQ ID NO: 579466 - DNA, 479 bp, Homo sapiens
  misc_feature: HIJSMM301BZHT9.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacacaccctgcgtggttttggctgttcggcggcgggac

SEQ ID NO: 579467 - DNA, 497 bp, Homo sapiens
  misc_feature: HIJSMM301CEBQB.51.9.A09.1.454.light.4.raw
cgatcgtatacacgaccggtgctcgatttagcgagacgcgcagggggcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggatttactcatctctgggctccagtctgaggatgaggctgactattactgtttgatttggcacagcagcgcttgggtattcggcgggggaccaaactgaccgtcctaggtcagcccaaggctgccccctcggt

SEQ ID NO: 579468 - DNA, 488 bp, Homo sapiens
  misc_feature: HIJSMM301CVKHS.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggatcaagctgaccgtcctaggtcagccaaggctgccccctcggtcactctcgttcccaccctcctcga

SEQ ID NO: 579469 - DNA, 498 bp, Homo sapiens
  misc_feature: HIJSMM301C1DNH.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcgggcggagggaccaaggtgaccgtcctacgtcagcccaaggctgccccctcggtcactctcg

SEQ ID NO: 579470 - DNA, 505 bp, Homo sapiens; identical to SEQ ID NO: 535503
  misc_feature: HIJSMM301EKWPA.8.28.C06.1.454.light.4.raw

SEQ ID NO: 579471 - DNA, 496 bp, Homo sapiens; identical to SEQ ID NO: 535541
  misc_feature: HIJSMM301D4QYL.3.33.C11.1.454.light.4.raw

SEQ ID NO: 579472 - DNA, 485 bp, Homo sapiens
  misc_feature: HIJSMM301AOMTM.49.38.D05.1.454.light.4.raw
agtcgagagacacgaccggtgctcgatttagtatctgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtcggagatcaaacg

SEQ ID NO: 579473 - DNA, 472 bp, Homo sapiens
  misc_feature: HIJSMM301BX98M.49.83.H06.1.454.light.4.raw
agtcgagagacacgaccggtgctcgatttagatcacgtgcgtcgcggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaactgtgg

SEQ ID NO: 579474 - DNA, 491 bp, Homo sapiens; identical to SEQ ID NO: 536373
  misc_feature: HIJSMM301B6E7R.13.46.E02.1.454.light.4.raw

SEQ ID NO: 579475 - DNA, 514 bp, Homo sapiens; identical to SEQ ID NO: 543100
  misc_feature: HIJSMM301CGBIJ.8.23.C01.1.454.light.4.raw

SEQ ID NO: 579476 - DNA, 489 bp, Homo sapiens; identical to SEQ ID NO: 535139
  misc_feature: HIJSMM301BXVLK.14.55.E11.1.454.light.4.raw

SEQ ID NO: 579477 - DNA, 497 bp, Homo sapiens; identical to SEQ ID NO: 535664
  misc_feature: HIJSMM301DM3NB.22.14.B03.1.454.light.4.raw

SEQ ID NO: 579478 - DNA, 489 bp, Homo sapiens; identical to SEQ ID NO: 576308
  misc_feature: HIJSMM301AQC2C.13.46.E02.1.454.light.4.raw

SEQ ID NO: 579479 - DNA, 481 bp, Homo sapiens
  misc_feature: HIJSMM301AYDA7.49.79.H02.1.454.light.4.raw
agtcgagagacacgaccggtgctcgatttagtgtcacacgaagggaaaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacgaggggtcccatcaaggttcagtggaagtggctctgggacagtattttactttcaccatcagcaggctgcagcctgaagatattgcaacatattactgtcaacagtatgatagtctcccgctcacgtttcgggcgggggaccaaggtggagatcaagcgaactggtggcgtgcaa

SEQ ID NO: 579480 - DNA, 520 bp, Homo sapiens; identical to SEQ ID NO: 546218
  misc_feature: HIJSMM301CFGWC.12.71.G05.1.454.light.4.raw

SEQ ID NO: 579481 - DNA, 489 bp, Homo sapiens; identical to SEQ ID NO: 543809
  misc_feature: HIJSMM301DQY08.19.71.G05.1.454.light.4.raw

SEQ ID NO: 579482 - DNA, 473 bp, Homo sapiens; identical to SEQ ID NO: 537115
  misc_feature: HIJSMM301BU2E5.13.48.E04.1.454.light.4.raw

SEQ ID NO: 579483 - DNA, 503 bp, Homo sapiens
  misc_feature: HIJSMM301CP5L5.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgacccgattccagaggcagcgggtctgggacagatttcactctcaccatcaccaacctgcaggctgaagatgtggcagtttattactgtcagcaatactatagtcctctctcacgtttcggcggagggaccaaggtggagatcaaacgaactgtggctgcaccatctgtctt

SEQ ID NO: 579484 - DNA, 485 bp, Homo sapiens
  misc_feature: HIJSMM301EFWWO.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgttcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 579485 - DNA, 494 bp, Homo sapiens
  misc_feature: HIJSMM301AQELA.46.67.G01.1.454.light.4.raw
actagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttcggtccaagggacacgactacaaattaaacgaactagtggctgcaccatctgtcttcatcttccccgccat

SEQ ID NO: 579486 - DNA, 520 bp, Homo sapiens
  misc_feature: HIJSMM301BNCKG.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccacctgtcactctgttcccaccctcctccgt

SEQ ID NO: 579487 - DNA, 514 bp, Homo sapiens
  misc_feature: HIJSMM301CZO7J.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggtttcggcggtgggaccaagctgaccgtcctaagtcagcccaaggctgccccctcggtccactctgttccccg

SEQ ID NO: 579488 - DNA, 518 bp, Homo sapiens
  misc_feature: HIJSMM301B1PG5.12.71.G05.1.454.light.4.raw
atacgacgtacacgaccggtgctcgatttagtgtcgtcgcaagagagagggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttttgacctagtctcctggtaccaacaataccccggcaaagtccccaagttaatcatttatgaggacactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaggtcagcccaaggctgccccctcggtcactctgttcccgccct

SEQ ID NO: 579489 - DNA, 487 bp, Homo sapiens; identical to SEQ ID NO: 540557
  misc_feature: HIJSMM301DYYE0.41.44.D11.1.454.light.4.raw

SEQ ID NO: 579490 - DNA, 495 bp, Homo sapiens
  misc_feature: HIJSMM301AEWUG.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactggtggctgcaccatct

SEQ ID NO: 579491 - DNA, 504 bp, Homo sapiens
  misc_feature: HIJSMM301BHN40.9.71.G05.1.454.light.4.raw
tgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccgcctcctctacg

SEQ ID NO: 579492 - DNA, 508 bp, Homo sapiens; identical to SEQ ID NO: 547873
  misc_feature: HIJSMM301ASEXV.47.83.H06.1.454.light.4.raw

SEQ ID NO: 579493 - DNA, 499 bp, Homo sapiens
  misc_feature: HIJSMM301CJ0RD.7.71.G05.1.454.light.4.raw
  modified_base (492)..(492): a, c, t, g, unknown or other
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggctccggggccgacttcggcctcggacgaacgagtagatactaacaactagtgcgtgnccactct

SEQ ID NO: 579494 - DNA, 489 bp, Homo sapiens
  misc_feature: HIJSMM301CX0LA.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaaggacacgactggagattaaacgaa

SEQ ID NO: 579495 - DNA, 416 bp, Homo sapiens; identical to SEQ ID NO: 536892
  misc_feature: HIJSMM301ARGSQ.16.46.E02.1.454.light.4.raw

SEQ ID NO: 579496 - DNA, 503 bp, Homo sapiens
  misc_feature: HIJSMM301AWZWQ.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacactttttggccagggggtccaagctggagatgaaacgaactgtggctgcaccatctgtcttcatcttccccg

SEQ ID NO: 579497 - DNA, 508 bp, Homo sapiens
  misc_feature: HIJSMM301AEYL6.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagggctcatatgcaggcagcagcaatgtacttttcggtcggagggaccaagctgaccgtcctgggtcagcccaggctgccccctccggtccta

SEQ ID NO: 579498 - DNA, 494 bp, Homo sapiens; identical to SEQ ID NO: 576031
  misc_feature: HIJSMM301AMZLN.12.23.C01.1.454.light.4.raw

SEQ ID NO: 579499 - DNA, 510 bp, Homo sapiens; identical to SEQ ID NO: 543290
  misc_feature: HIJSMM301EGDKA.5.58.F03.1.454.light.4.raw

SEQ ID NO: 579500 - DNA, 507 bp, Homo sapiens
  misc_feature: HIJSMM301B2QKC.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtctaggtcagccaaggctgccccctcggtcactctgtt

SEQ ID NO: 579501 - DNA, 478 bp, Homo sapiens; identical to SEQ ID NO: 541146
  misc_feature: HIJSMM301CFFGY.21.25.C03.1.454.light.4.raw

SEQ ID NO: 579502 - DNA, 521 bp, Homo sapiens; identical to SEQ ID NO: 539470
  misc_feature: HIJSMM301C6241.27.23.C01.1.454.light.4.raw

SEQ ID NO: 579503 - DNA, 494 bp, Homo sapiens
  misc_feature: HIJSMM301A1QJS.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccaggggaccgaacggtggaaagtcaaaacgaactacgtggctgcacca

SEQ ID NO: 579504 - DNA, 506 bp, Homo sapiens
  misc_feature: HIJSMM301DIDQ2.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtctaggtcagcccaaggcccaaccc

SEQ ID NO: 579505 - DNA, 483 bp, Homo sapiens; identical to SEQ ID NO: 540738
  misc_feature: HIJSMM301A0TN5.48.85.H08.1.454.light.4.raw

SEQ ID NO: 579506 - DNA, 486 bp, Homo sapiens
  misc_feature: HIJSMM301DBIBE.13.87.H10.1.454.light.4.raw
tcacgtactacacgaccggtgctcgatttagcagtactgcgttgggtttgggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttaccgctcagtttcggcggagggaccaaggtggagatcaaacgaactgtggctgcaccatctgtcttca

SEQ ID NO: 579507 - DNA, 487 bp, Homo sapiens
  misc_feature: HIJSMM301BUY9R.40.83.H06.1.454.light.4.raw
tctagcgactcacgaccggtgctcgatttagatcacgtgcgtcgcggggcaaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagacccg

SEQ ID NO: 579508 - DNA, 494 bp, Homo sapiens; identical to SEQ ID NO: 534992
  misc_feature: HIJSMM301AIP27.9.1.A01.1.454.light.4.raw

SEQ ID NO: 579509 - DNA, 488 bp, Homo sapiens; identical to SEQ ID NO: 535568
  misc_feature: HIJSMM301C92V2.21.4.A04.1.454.light.4.raw

SEQ ID NO: 579510 - DNA, 389 bp, Homo sapiens; identical to SEQ ID NO: 558170
  misc_feature: HIJSMM301BIULP.21.40.D07.1.454.light.4.raw

SEQ ID NO: 579511 - DNA, 444 bp, Homo sapiens; identical to SEQ ID NO: 535192
  misc_feature: HIJSMM301EA7W9.5.9.A09.1.454.light.4.raw

SEQ ID NO: 579512 - DNA, 509 bp, Homo sapiens
  misc_feature: HIJSMM301D8N84.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcta

SEQ ID NO: 579513 - DNA, 497 bp, Homo sapiens
  misc_feature: HIJSMM301CH2H4.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggtgttcggcggagggaccaaggctgacccgtcctcagtcacgaccccg

SEQ ID NO: 579514 - DNA, 516 bp, Homo sapiens
  misc_feature: HIJSMM301EOJ47.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccaacgggaccgaacggtaggagtacaaacgaactagtggcgtgcaccactctgtcttctatcttcccgtcccact

SEQ ID NO: 579515 - DNA, 480 bp, Homo sapiens
  misc_feature: HIJSMM301EUSUW.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactagtggctgca

SEQ ID NO: 579516 - DNA, 502 bp, Homo sapiens
  misc_feature: HIJSMM301CF7NH.10.68.G02.1.454.light.4.raw
catagtagtgcacgaccggtgctcgattagtcgatagtgaagggaaaggggggtgtgggctcaggaggcagagctctgggaatctcaccatggcctggacccctctcctgctccccctcctcactttctgcacagtctctgcggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtgggcccagggggtcgatgaggctgactactactgtttctcgactgacttcactggtaaacgttggctgttcggcggagggaccaagctgaccgtcctgcgtcagcccaaggctgccccctcggtcacttcc

SEQ ID NO: 579517 - DNA, 511 bp, Homo sapiens
  misc_feature: HIJSMM301DBZCQ.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccacgccaggttcgatggcagtgggtctgggacagacttcactctcaccatcagcagcctggagcctgaagatattgcagtttattattgttcagcagcgtagcaggtggcctttctacttcggtcccggggaccaacgtaggaaatacaaacgaactgtggctgcaccatctgtcttcatctcccgcc

SEQ ID NO: 579518 - DNA, 494 bp, Homo sapiens; identical to SEQ ID NO: 537805
  misc_feature: HIJSMM301DHYHI.51.6.A06.1.454.light.4.raw

SEQ ID NO: 579519 - DNA, 509 bp, Homo sapiens
  misc_feature: HIJSMM301D2NAN.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcactcttccggggtccctgatcgcttctctggctccatccttgggaacaaagctgccctcaccatcacggggcccaggcagacgatgaatgtgattatcactgcgtcctttatgtgggcgtggcatttgggtgttcggcggagggaccaaactgaccgtcctaggtcagcccaaggctgccccctcggtcactctcg

SEQ ID NO: 579520 - DNA, 504 bp, Homo sapiens
  misc_feature: HIJSMM301DGZAM.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcgggcggagggaccaaggtgaccgtccaggtcagcccaaggctgccccccg

SEQ ID NO: 579521 - DNA, 506 bp, Homo sapiens; identical to SEQ ID NO: 560391
  misc_feature: HIJSMM301C69KM.19.85.H08.1.454.light.4.raw

SEQ ID NO: 579522 - DNA, 500 bp, Homo sapiens
  misc_feature: HIJSMM301CCQIJ.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaacctccctcaacgttcggcggacgggaccgaaggtaggagactacaaacgaactgtggctgacaccatctgtcttcta

SEQ ID NO: 579523 - DNA, 523 bp, Homo sapiens
  misc_feature: HIJSMM301DRGY1.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctccctccgtcg

SEQ ID NO: 579524 - DNA, 488 bp, Homo sapiens
  misc_feature: HIJSMM301AQ2T8.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaaggtggagatcaaacgaactgt

SEQ ID NO: 579525 - DNA, 481 bp, Homo sapiens
  misc_feature: HIJSMM301ANWUW.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcatgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctggactaaggtggagatcagacgaactgtggctgcaccatctgtctt

SEQ ID NO: 579526 - DNA, 498 bp, Homo sapiens
  misc_feature: HIJSMM301D0F2A.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggcctggacgttcggccaagggaccaaggtggaaatacaacgaactagtggctgcacc

SEQ ID NO: 579527 - DNA, 489 bp, Homo sapiens
  misc_feature: HIJSMM301CV5C3.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctacgtcagccaaggctgccccctcggt

SEQ ID NO: 579528 - DNA, 501 bp, Homo sapiens; identical to SEQ ID NO: 550407
  misc_feature: HIJSMM301AO2C0.4.39.D06.1.454.light.4.raw

SEQ ID NO: 579529 - DNA, 479 bp, Homo sapiens; identical to SEQ ID NO: 535118
  misc_feature: HIJSMM301AI90R.13.59.F04.1.454.light.4.raw

SEQ ID NO: 579530 - DNA, 498 bp, Homo sapiens; identical to SEQ ID NO: 537020
  misc_feature: HIJSMM301DEZT3.26.26.C04.1.454.light.4.raw

SEQ ID NO: 579531 - DNA, 505 bp, Homo sapiens
  misc_feature: HIJSMM301ETE7P.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgagatgttgcagtttattactgtcaacatcgtaccgagtggcctccgggggccacttcggccctgggaccaaggtggagatcaaacgaactgtggctgcaccatctgtcttctat

SEQ ID NO: 579532 - DNA, 492 bp, Homo sapiens
  misc_feature: HIJSMM301BUKF0.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcaccctcgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaaatgaactgtggctgcacatctgtctt

SEQ ID NO: 579533 - DNA, 447 bp, Homo sapiens; identical to SEQ ID NO: 535201
  misc_feature: HIJSMM301AHOQS.18.9.A09.1.454.light.4.raw

SEQ ID NO: 579534 - DNA, 510 bp, Homo sapiens
  misc_feature: HIJSMM301CUNGZ.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccgaagctgaccgtcctgggtcagcccaaggctcgcccctcggtcactctcgttcctccctcccttcctccgtactcgt

SEQ ID NO: 579535 - DNA, 514 bp, Homo sapiens; identical to SEQ ID NO: 547648
  misc_feature: HIJSMM301ATV8M.16.1.A01.1.454.light.4.raw

SEQ ID NO: 579536 - DNA, 499 bp, Homo sapiens; identical to SEQ ID NO: 541641
  misc_feature: HIJSMM301DDY77.51.80.H03.1.454.light.4.raw

SEQ ID NO: 579537 - DNA, 468 bp, Homo sapiens
  misc_feature: HIJSMM301DLW0O.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaattcaccatcagcagcctccaacgtgatgatgttgcaacatactattgtcagcaatatgattttgctctccgagtgccactttggcgggggaccaaggtggacatcaaacgaa

SEQ ID NO: 579538 - DNA, 482 bp, Homo sapiens; identical to SEQ ID NO: 542732
  misc_feature: HIJSMM301CNCJY.7.75.G09.1.454.light.4.raw

SEQ ID NO: 579539 - DNA, 455 bp, Homo sapiens
  misc_feature: HIJSMM301EVSGD.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctcgttcccaccctcctccacgagagta

SEQ ID NO: 579540 - DNA, 478 bp, Homo sapiens
  misc_feature: HIJSMM301EZ97L.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggtggagggaccgcggtggagatcagacgaactgtggctgcaccatctgtctt

SEQ ID NO: 579541 - DNA, 489 bp, Homo sapiens
  misc_feature: HIJSMM301BKJ77.22.86.H09.1.454.light.4.raw
acatacgcgtcacgaccggtgctcgatttagtgctatagacttgggtttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaa

SEQ ID NO: 579542 - DNA, 503 bp, Homo sapiens; identical to SEQ ID NO: 540136
  misc_feature: HIJSMM301EC2W4.19.10.A10.1.454.light.4.raw

SEQ ID NO: 579543 - DNA, 494 bp, Homo sapiens
  misc_feature: HIJSMM301A7Z4U.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccagggaccgaaggtggaaggtcaagacgaactagtggcgtgcaccaatctgtt

SEQ ID NO: 579544 - DNA, 502 bp, Homo sapiens
  misc_feature: HIJSMM301EELBR.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaattatgaggtcactaagcggccctcaggggtttctggtcgcttctctgcctccaagtctggcaacacggcctccctgacaatctctgggctccagtctgacgacgaggctgattattactgcagctcatatgcagttggtttcctctttcaagatattcggcggagggaccaggctgaccgtcctgagtcagcccaaggctgcccccc

SEQ ID NO: 579545 - DNA, 507 bp, Homo sapiens
  misc_feature: HIJSMM301AJ8XF.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccgaagctgaccgtcctcgggtcagcccaaggctgccccctcggtcattctgttccctaccctccttacgtcgtat

SEQ ID NO: 579546 - DNA, 513 bp, Homo sapiens
  misc_feature: HIJSMM301BE4JL.10.26.C04.1.454.light.4.raw
catagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcgccgaaggaccaaggtggcaatcaaccgaactgtggctgcaccatctgtcttcatcttcccgccatctgacactact

SEQ ID NO: 579547 - DNA, 489 bp, Homo sapiens
  misc_feature: HIJSMM301AQAAP.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgca

SEQ ID NO: 579548 - DNA, 504 bp, Homo sapiens; identical to SEQ ID NO: 549053
  misc_feature: HIJSMM301B05X7.4.71.G05.1.454.light.4.raw

SEQ ID NO: 579549 - DNA, 498 bp, Homo sapiens; identical to SEQ ID NO: 571594
  misc_feature: HIJSMM301B0W8F.3.33.C11.1.454.light.4.raw

SEQ ID NO: 579550 - DNA, 510 bp, Homo sapiens; identical to SEQ ID NO: 535855
  misc_feature: HIJSMM301CKL3V.17.33.C11.1.454.light.4.raw

SEQ ID NO: 579551 - DNA, 489 bp, Homo sapiens
  misc_feature: HIJSMM301D2FQR.15.49.E05.1.454.light.4.raw
tctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaaacgaactagtggctgcaccatct

SEQ ID NO: 579552 - DNA, 494 bp, Homo sapiens; identical to SEQ ID NO: 534992
  misc_feature: HIJSMM301CXKA9.9.1.A01.1.454.light.4.raw

SEQ ID NO: 579553 - DNA, 496 bp, Homo sapiens
  misc_feature: HIJSMM301AO6DU.51.28.C06.1.454.light.4.raw
cgatcgtatacacgaccggtgctcgatttagagctcacgtattgggtttggggggccgtcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtggttcggcgggggaccgaagctgaccgtcctcggtcagcccaaggctgccccctccggtcactc

SEQ ID NO: 579554 - DNA, 496 bp, Homo sapiens
  misc_feature: HIJSMM301CTDBQ.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcaccatctgtctt

SEQ ID NO: 579555 - DNA, 478 bp, Homo sapiens; identical to SEQ ID NO: 535129
  misc_feature: HIJSMM301DM0TE.11.11.A11.1.454.light.4.raw

SEQ ID NO: 579556 - DNA, 505 bp, Homo sapiens
  misc_feature: HIJSMM301DT2B7.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatgggatgacaatctgagcggttgggtgttcggcggagggaccaaactgacccgtcctagggtcagcccaa

SEQ ID NO: 579557 - DNA, 512 bp, Homo sapiens
  misc_feature: HIJSMM301AILAZ.17.2.A02.1.454.light.4.raw
  modified_base (438)..(438): a, c, t, g, unknown or other
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtnttcggaactgggaccaaggtcaccgtcctacgtcagcccaaggccaaccccactgtcactctgttcccgaccct

SEQ ID NO: 579558 - DNA, 489 bp, Homo sapiens; identical to SEQ ID NO: 563798
  misc_feature: HIJSMM301B70M8.16.86.H09.1.454.light.4.raw

SEQ ID NO: 579559 - DNA, 502 bp, Homo sapiens; identical to SEQ ID NO: 541971
  misc_feature: HIJSMM301B2LSP.4.39.D06.1.454.light.4.raw

SEQ ID NO: 579560 - DNA, 510 bp, Homo sapiens; identical to SEQ ID NO: 562033
  misc_feature: HIJSMM301DES5K.15.76.G10.1.454.light.4.raw

SEQ ID NO: 579561 - DNA, 467 bp, Homo sapiens; identical to SEQ ID NO: 535997
  misc_feature: HIJSMM301A183Y.5.36.D03.1.454.light.4.raw

SEQ ID NO: 579562 - DNA, 497 bp, Homo sapiens
  misc_feature: HIJSMM301B9L1D.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggcccaagggacacgactggagattaaacgaactgtgg

SEQ ID NO: 579563 - DNA, 502 bp, Homo sapiens; identical to SEQ ID NO: 541971
  misc_feature: HIJSMM301DWHDV.4.39.D06.1.454.light.4.raw

SEQ ID NO: 579564 - DNA, 504 bp, Homo sapiens; identical to SEQ ID NO: 535561
  misc_feature: HIJSMM301ARWDC.4.57.F02.1.454.light.4.raw

SEQ ID NO: 579565 - DNA, 504 bp, Homo sapiens; identical to SEQ ID NO: 562026
  misc_feature: HIJSMM301EU60A.9.71.G05.1.454.light.4.raw

SEQ ID NO: 579566 - DNA, 484 bp, Homo sapiens
  misc_feature: HIJSMM301DFTEG.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgctagtttattactgtcagcactataataactggcctccgtactagttttggccaggggaccaaggctggagatacaaacgaa

SEQ ID NO: 579567 - DNA, 513 bp, Homo sapiens
  misc_feature: HIJSMM301EXVW2.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtctaagtcagcccaaggctgccccctggtcactctgtccca

SEQ ID NO: 579568 - DNA, 500 bp, Homo sapiens; identical to SEQ ID NO: 542309
  misc_feature: HIJSMM301AVVEU.12.86.H09.1.454.light.4.raw

SEQ ID NO: 579569 - DNA, 495 bp, Homo sapiens; identical to SEQ ID NO: 539288
  misc_feature: HIJSMM301DYDHD.9.1.A01.1.454.light.4.raw

SEQ ID NO: 579570 - DNA, 497 bp, Homo sapiens
  misc_feature: HIJSMM301BZUWC.16.78.H01.1.454.light.4.raw
tgtactactccacgaccggtgctcgatttagtgtgagtagtttggggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctcacggtacacttttggccagggaccaagctggagatcaaacgaactcgtggctgcaccatctgtt

SEQ ID NO: 579571 - DNA, 493 bp, Homo sapiens; identical to SEQ ID NO: 541489
  misc_feature: HIJSMM301DPFAD.12.23.C01.1.454.light.4.raw

SEQ ID NO: 579572 - DNA, 495 bp, Homo sapiens
  misc_feature: HIJSMM301C43N9.48.49.E05.1.454.light.4.raw
agtatacatacacgaccggtgctcgatttagagcgactagcaacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccaaggtggagatcaacgaactgtggctgcaccatctgtt

SEQ ID NO: 579573 - DNA, 486 bp, Homo sapiens; identical to SEQ ID NO: 535043
  misc_feature: HIJSMM301EL4KA.46.35.D02.1.454.light.4.raw

SEQ ID NO: 579574 - DNA, 447 bp, Homo sapiens; identical to SEQ ID NO: 535020
  misc_feature: HIJSMM301B6VDH.18.9.A09.1.454.light.4.raw

SEQ ID NO: 579575 - DNA, 486 bp, Homo sapiens; identical to SEQ ID NO: 543543
  misc_feature: HIJSMM301EUJ2V.49.3.A03.1.454.light.4.raw

SEQ ID NO: 579576 - DNA, 495 bp, Homo sapiens
  misc_feature: HIJSMM301EFE7D.40.62.F07.1.454.light.4.raw
tctagcgactcacgaccggtgctcgatttagtagtcgcataaagggaaagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaaggaccgacgggtggaaatacaaacgaactagtggctgcaccatctgtctt

SEQ ID NO: 579577 - DNA, 494 bp, Homo sapiens; identical to SEQ ID NO: 550275
  misc_feature: HIJSMM301EWN6E.11.59.F04.1.454.light.4.raw

SEQ ID NO: 579578 - DNA, 489 bp, Homo sapiens
  misc_feature: HIJSMM301ADD2U.52.3.A03.1.454.light.4.raw
cgcagtacgacacgaccggtgctcgatttagagagcgtcacaggggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaagcccctaaactcctgatctctaaggcatctgatttacaaactggggtcccgtcaaggttcagcggcagtggatctgggacagacttcactctcaccatcagcagcctgcagcctgatgactttgcaagttattattgccaacagtataactagtttttcattcacttttggccctgggacgacagtggatatcaaacgaactgtggctgcaccatctgtcttcta

SEQ ID NO: 579579 - DNA, 494 bp, Homo sapiens
  misc_feature: HIJSMM301C38B5.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaagggtggagatcaaacgaactgtggcctgcaccatctgtcttcatcttcccgccat

SEQ ID NO: 579580 - DNA, 501 bp, Homo sapiens
  misc_feature: HIJSMM301BWJJ1.8.86.H09.1.454.light.4.raw
ctcgcgtgtccacgaccggtgctcgatttagtgctatagacttgggtttgggggagagactgaagaacccagccttgcagcagctccaccatggcctgggctcctctgctcctcaccctcctcagtctcctcacagggtccctctcccagcctgtactgactcagccaccctctgcatcagcctccctgggagcctcggtcacactcacctgcaccctgagcagcggctacagtaattataacgtggactggtaccagcagagaccagggaagggcccccggtttgtgatgcgagtgggcactggtgggattgtgggatccaagggggaaggcttccctgatcgcttctcagtcttgggctcaggcctgaatcggtacctgaccatcaagagcatccaggaagaggatgagagtgactactactgtggggcagaccatggcagtgccactggaaacaacttcgtgtatgtgttcggcggagggactaagctgaccgtccta

SEQ ID NO: 579581 - DNA, 458 bp, Homo sapiens
  misc_feature: HIJSMM301C457Z.49.83.H06.1.454.light.4.raw
agtcgagagacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatccagcgggactcaggctatcgatgaggctgactattactgtcaggcgtgggacagccgcactggggtattcggcggagggaccaagctgaccgt

SEQ ID NO: 579582 - DNA, 503 bp, Homo sapiens
  misc_feature: HIJSMM301BNLJO.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcacttc

SEQ ID NO: 579583 - DNA, 514 bp, Homo sapiens; identical to SEQ ID NO: 541418
  misc_feature: HIJSMM301B15V8.17.33.C11.1.454.light.4.raw

SEQ ID NO: 579584 - DNA, 486 bp, Homo sapiens; identical to SEQ ID NO: 547345
  misc_feature: HIJSMM301DC7AQ.47.78.H01.1.454.light.4.raw

SEQ ID NO: 579585 - DNA, 512 bp, Homo sapiens; identical to SEQ ID NO: 563627
  misc_feature: HIJSMM301CK0S1.43.59.F04.1.454.light.4.raw

SEQ ID NO: 579586 - DNA, 493 bp, Homo sapiens; identical to SEQ ID NO: 535047
  misc_feature: HIJSMM301C1UHB.16.53.E09.1.454.light.4.raw

SEQ ID NO: 579587 - DNA, 486 bp, Homo sapiens; identical to SEQ ID NO: 535043
  misc_feature: HIJSMM301AIOQY.46.35.D02.1.454.light.4.raw

SEQ ID NO: 579588 - DNA, 457 bp, Homo sapiens; identical to SEQ ID NO: 542093
  misc_feature: HIJSMM301DL9EZ.13.23.C01.1.454.light.4.raw

SEQ ID NO: 579589 - DNA, 477 bp, Homo sapiens; identical to SEQ ID NO: 564533
  misc_feature: HIJSMM301D9MC1.4.10.A10.1.454.light.4.raw

SEQ ID NO: 579590 - DNA, 441 bp, Homo sapiens
  misc_feature: HIJSMM301CNF8O.18.9.A09.1.454.light.4.raw
  modified_base (406)..(406): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctggaccaggtcacgtctaagtcagccaaggccaacccnctgtcactctgttcccaccctcctccatactcgta

SEQ ID NO: 579591 - DNA, 515 bp, Homo sapiens
  misc_feature: HIJSMM301BGA7N.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagccaaggctcgccccctcggtcactctcgttccccg

SEQ ID NO: 579592 - DNA, 522 bp, Homo sapiens; identical to SEQ ID NO: 541090
  misc_feature: HIJSMM301AT9FR.27.23.C01.1.454.light.4.raw

SEQ ID NO: 579593 - DNA, 521 bp, Homo sapiens
  misc_feature: HIJSMM301C9V7A.27.23.C01.1.454.light.4.raw
  modified_base (485)..(485): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggtagggaccaggctgaccgtcctaggtcancccaaggctgccccctcggtcactctgttccaccct

SEQ ID NO: 579594 - DNA, 499 bp, Homo sapiens
  misc_feature: HIJSMM301AVKB1.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagccgaccctccggaatccctgagagagtcgctggctccaggtcagggacaatggccaccttgactatcactgggacccagatggacgatgaaggtgactaccactgttattcgacagacagcagtggtagtcgagggggtcttcgggcggagggacgaagctgaccgtcctgagtcagcccaaggctcgccccctggtcactc

SEQ ID NO: 579595 - DNA, 480 bp, Homo sapiens; identical to SEQ ID NO: 535291
  misc_feature: HIJSMM301DJUUE.22.59.F04.1.454.light.4.raw

SEQ ID NO: 579596 - DNA, 500 bp, Homo sapiens
  misc_feature: HIJSMM301EZJ2R.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtggaaagcaaacgaactgtggctgcaccatctgtcttcatcttccccg

SEQ ID NO: 579597 - DNA, 507 bp, Homo sapiens
  misc_feature: HIJSMM301EV5OV.43.3.A03.1.454.light.4.raw
tgtgagtagtcacgaccggtgctcgatttagagagcgtcacagggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtcctaggtcagcccaaggctgccccctcggtcactctgttccca

SEQ ID NO: 579598 - DNA, 499 bp, Homo sapiens
  misc_feature: HIJSMM301ARSZK.41.18.B07.1.454.light.4.raw
tctatactatcacgaccggtgctcgatttagtcgctgcgtaagggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttattcgggtgttcggcggggggaccgaaggctgaccgtcctaggtcagccaaggctccg

SEQ ID NO: 579599 - DNA, 448 bp, Homo sapiens
  misc_feature: HIJSMM301AH26C.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 579600 - DNA, 523 bp, Homo sapiens
  misc_feature: HIJSMM301DWDMZ.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgttagaccacgacgtcgccctcccgtcgactctcgttcctaccctccctcctacg

SEQ ID NO: 579601 - DNA, 502 bp, Homo sapiens; identical to SEQ ID NO: 537816
  misc_feature: HIJSMM301BNS0O.19.78.H01.1.454.light.4.raw

SEQ ID NO: 579602 - DNA, 491 bp, Homo sapiens; identical to SEQ ID NO: 535294
  misc_feature: HIJSMM301EMWZA.16.68.G02.1.454.light.4.raw

SEQ ID NO: 579603 - DNA, 499 bp, Homo sapiens; identical to SEQ ID NO: 536578
  misc_feature: HIJSMM301DT6U7.22.27.C05.1.454.light.4.raw

SEQ ID NO: 579604 - DNA, 478 bp, Homo sapiens
  misc_feature: HIJSMM301C0I72.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagttttattactgtcagcagtattgtgaagctccgctcactttcggcggaggaccgcggtggagatcagacgaactgtggctgcaccatctgtctt

SEQ ID NO: 579605 - DNA, 447 bp, Homo sapiens; identical to SEQ ID NO: 535020
  misc_feature: HIJSMM301CVPJD.18.9.A09.1.454.light.4.raw

SEQ ID NO: 579606 - DNA, 495 bp, Homo sapiens; identical to SEQ ID NO: 537273
  misc_feature: HIJSMM301BRK8Y.15.26.C04.1.454.light.4.raw

SEQ ID NO: 579607 - DNA, 485 bp, Homo sapiens; identical to SEQ ID NO: 535985
  misc_feature: HIJSMM301BU372.15.1.A01.1.454.light.4.raw

SEQ ID NO: 579608 - DNA, 504 bp, Homo sapiens
  misc_feature: HIJSMM301EDR8I.48.67.G01.1.454.light.4.raw
agtatacatacacgaccggtgctcgatttagagtatacatattgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacggttcggcggagggaccaaggtggacatcaaacgaactgtggctgcaccatctgtcttcatcttccccg

SEQ ID NO: 579609 - DNA, 486 bp, Homo sapiens; identical to SEQ ID NO: 539294
  misc_feature: HIJSMM301A0JSC.12.33.C11.1.454.light.4.raw

SEQ ID NO: 579610 - DNA, 447 bp, Homo sapiens; identical to SEQ ID NO: 535020
  misc_feature: HIJSMM301C4ZLT.18.9.A09.1.454.light.4.raw

SEQ ID NO: 579611 - DNA, 487 bp, Homo sapiens
  misc_feature: HIJSMM301AJG00.52.23.C01.1.454.light.4.raw
cgcagtacgacacgaccggtgctcgatttagtacacgtgattagggattggggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgttcaacaatatgaagatctccccctcactttcggcggagggaccaaggtggaggatcagacgaactgtggctgcaccat

SEQ ID NO: 579612 - DNA, 484 bp, Homo sapiens; identical to SEQ ID NO: 535400
  misc_feature: HIJSMM301A837G.46.26.C04.1.454.light.4.raw

SEQ ID NO: 579613 - DNA, 502 bp, Homo sapiens; identical to SEQ ID NO: 536253
  misc_feature: HIJSMM301BT0H5.21.22.B11.1.454.light.4.raw

SEQ ID NO: 579614 - DNA, 487 bp, Homo sapiens
  misc_feature: HIJSMM301AEAKE.10.77.G11.1.454.light.4.raw
  modified_base (457)..(457): a, c, t, g, unknown or other
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcgacgtcgtcagacgaacgagacganacacagacacgtagcgtgcgacacactctc

SEQ ID NO: 579615 - DNA, 497 bp, Homo sapiens; identical to SEQ ID NO: 536371
  misc_feature: HIJSMM301B9TIH.16.78.H01.1.454.light.4.raw

SEQ ID NO: 579616 - DNA, 508 bp, Homo sapiens; identical to SEQ ID NO: 540739
  misc_feature: HIJSMM301AJQTH.14.7.A07.1.454.light.4.raw

SEQ ID NO: 579617 - DNA, 486 bp, Homo sapiens; identical to SEQ ID NO: 535043
  misc_feature: HIJSMM301BPKJE.46.35.D02.1.454.light.4.raw

SEQ ID NO: 579618 - DNA, 481 bp, Homo sapiens; identical to SEQ ID NO: 535993
  misc_feature: HIJSMM301CZ1N5.21.25.C03.1.454.light.4.raw

SEQ ID NO: 579619 - DNA, 513 bp, Homo sapiens; identical to SEQ ID NO: 544090
  misc_feature: HIJSMM301DRSF3.17.37.D04.1.454.light.4.raw

SEQ ID NO: 579620 - DNA, 500 bp, Homo sapiens
  misc_feature: HIJSMM301D3P4S.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcggggcgttcggccaagggaccaaggtggaaagtacaaacgaactgtggctgcacca

SEQ ID NO: 579621 - DNA, 466 bp, Homo sapiens; identical to SEQ ID NO: 536398
  misc_feature: HIJSMM301AE4HL.3.20.B09.1.454.light.4.raw

SEQ ID NO: 579622 - DNA, 490 bp, Homo sapiens
  misc_feature: HIJSMM301D1222.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaagaactgtggctgcaccatctgtcttcatt

SEQ ID NO: 579623 - DNA, 488 bp, Homo sapiens; identical to SEQ ID NO: 537124
  misc_feature: HIJSMM301BGXZ9.11.25.C03.1.454.light.4.raw

SEQ ID NO: 579624 - DNA, 498 bp, Homo sapiens
  misc_feature: HIJSMM301BKMCE.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaacggaccgaaggtaggaaagtacaaacgaactagtggctgcaccatctgtcttctatcttccccg

SEQ ID NO: 579625 - DNA, 492 bp, Homo sapiens; identical to SEQ ID NO: 536087
  misc_feature: HIJSMM301A3CXA.10.17.B06.1.454.light.4.raw

SEQ ID NO: 579626 - DNA, 483 bp, Homo sapiens; identical to SEQ ID NO: 547051
  misc_feature: HIJSMM301DSDHU.46.26.C04.1.454.light.4.raw

SEQ ID NO: 579627 - DNA, 484 bp, Homo sapiens
  misc_feature: HIJSMM301DE5JZ.49.3.A03.1.454.light.4.raw
  modified_base (189)..(189): a, c, t, g, unknown or other
agtcgagagacacgaccggtgctcgatttagagagcgtcacaggggaggaactgctcagttaggacccagacggaaccatggaagccccagcgcagcttctcttcctcctgctactctggctcccagataccactggagaaatagtgatgacgcagtctccagccactttgtctgtgtctccagggganagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggccgggaccaaggtggagatcaaacgaactgtggctgcaccatctgtt

SEQ ID NO: 579628 - DNA, 475 bp, Homo sapiens; identical to SEQ ID NO: 554487
  misc_feature: HIJSMM301BXHON.13.76.G10.1.454.light.4.raw

SEQ ID NO: 579629 - DNA, 505 bp, Homo sapiens; identical to SEQ ID NO: 539292
  misc_feature: HIJSMM301BOHOT.19.85.H08.1.454.light.4.raw

SEQ ID NO: 579630 - DNA, 510 bp, Homo sapiens
  misc_feature: HIJSMM301D2Q30.3.37.D04.1.454.light.4.raw
agacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggccaaccccactgtacactc

SEQ ID NO: 579631 - DNA, 496 bp, Homo sapiens; identical to SEQ ID NO: 536802
  misc_feature: HIJSMM301AOT1L.5.24.C02.1.454.light.4.raw

SEQ ID NO: 579632 - DNA, 492 bp, Homo sapiens
  misc_feature: HIJSMM301CY1B0.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagccc

SEQ ID NO: 579633 - DNA, 506 bp, Homo sapiens
  misc_feature: HIJSMM301EPUXC.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgtcagtttattacttgtcagcagcgtagcatctggcctccgtacacctttcggccaggggaccccccgaagctggagatacaaacgaactgtggctgcaccatctgtcttc

SEQ ID NO: 579634 - DNA, 486 bp, Homo sapiens; identical to SEQ ID NO: 535043
  misc_feature: HIJSMM301BAFZ7.46.35.D02.1.454.light.4.raw

SEQ ID NO: 579635 - DNA, 495 bp, Homo sapiens
  misc_feature: HIJSMM301DMK20.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccggggaccaagctggaaatcaagcgaactgtggctgcaccatctgtcttcattccc

SEQ ID NO: 579636 - DNA, 486 bp, Homo sapiens; identical to SEQ ID NO: 535385
  misc_feature: HIJSMM301B4LXI.19.71.G05.1.454.light.4.raw

SEQ ID NO: 579637 - DNA, 479 bp, Homo sapiens
  misc_feature: HIJSMM301AEINB.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattacctggactccagcctgaggacgaggctgactattactgctcagcagtggacagcagcctccgtggtgtggtgagtcggcggagggaccaggctcgaccgtcct

SEQ ID NO: 579638 - DNA, 502 bp, Homo sapiens; identical to SEQ ID NO: 557953
  misc_feature: HIJSMM301BYLEW.15.57.F02.1.454.light.4.raw

SEQ ID NO: 579639 - DNA, 465 bp, Homo sapiens; identical to SEQ ID NO: 555872
  misc_feature: HIJSMM301DY7KF.5.36.D03.1.454.light.4.raw

SEQ ID NO: 579640 - DNA, 501 bp, Homo sapiens
  misc_feature: HIJSMM301D0M9V.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccactgtcact

SEQ ID NO: 579641 - DNA, 465 bp, Homo sapiens
  misc_feature: HIJSMM301D675D.52.2.A02.1.454.light.4.raw
cgcagtacgacacgaccggtgctcgatttagactcatctacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacagggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaa

SEQ ID NO: 579642 - DNA, 522 bp, Homo sapiens
  misc_feature: HIJSMM301AN0B5.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccacggacgaacggtaggaagtacgaaacgaacctaagtggcgtgcgaccatctgtcttctactcttcccgtcccactctcgt

SEQ ID NO: 579643 - DNA, 515 bp, Homo sapiens; identical to SEQ ID NO: 559497
  misc_feature: HIJSMM301EKZ4H.10.86.H09.1.454.light.4.raw

SEQ ID NO: 579644 - DNA, 508 bp, Homo sapiens
  misc_feature: HIJSMM301EMCAW.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcacccacctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctggtcactctgtt

SEQ ID NO: 579645 - DNA, 491 bp, Homo sapiens
  misc_feature: HIJSMM301BZ8UH.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggataatcagacgaactgtgg

SEQ ID NO: 579646 - DNA, 350 bp, Homo sapiens
  misc_feature: HIJSMM301DPT8B.3.11.A11.1.454.light.4.raw
agacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatctgtcttcatcttcccgccatctgagaggtct

SEQ ID NO: 579647 - DNA, 514 bp, Homo sapiens; identical to SEQ ID NO: 541418
  misc_feature: HIJSMM301B9EMU.17.33.C11.1.454.light.4.raw

SEQ ID NO: 579648 - DNA, 487 bp, Homo sapiens
  misc_feature: HIJSMM301AQWVA.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcgggtttattactgcatgcagggtacagtgtggccttcgctcgcattcggcggagggaccaaggtggagatcaaacgaa

SEQ ID NO: 579649 - DNA, 497 bp, Homo sapiens
  misc_feature: HIJSMM301C0WX8.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactgtggctgcac

SEQ ID NO: 579650 - DNA, 510 bp, Homo sapiens
  misc_feature: HIJSMM301A5BJD.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgtattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccct

SEQ ID NO: 579651 - DNA, 479 bp, Homo sapiens; identical to SEQ ID NO: 540873
  misc_feature: HIJSMM301DMIC5.40.59.F04.1.454.light.4.raw

SEQ ID NO: 579652 - DNA, 471 bp, Homo sapiens; identical to SEQ ID NO: 536321
  misc_feature: HIJSMM301D0W7E.15.8.A08.1.454.light.4.raw

SEQ ID NO: 579653 - DNA, 481 bp, Homo sapiens
  misc_feature: HIJSMM301DA9FH.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagccaaggctcgccccctcggtcactctgttcccaccctcctccgtgtcctgat

SEQ ID NO: 579654 - DNA, 485 bp, Homo sapiens; identical to SEQ ID NO: 535688
  misc_feature: HIJSMM301DPA5Z.19.5.A05.1.454.light.4.raw

SEQ ID NO: 579655 - DNA, 493 bp, Homo sapiens; identical to SEQ ID NO: 571339
  misc_feature: HIJSMM301AKIT1.10.72.G06.1.454.light.4.raw

SEQ ID NO: 579656 - DNA, 516 bp, Homo sapiens
  misc_feature: HIJSMM301BCMDP.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctcgccccctcggtcactcg

SEQ ID NO: 579657 - DNA, 508 bp, Homo sapiens
  misc_feature: HIJSMM301D98BK.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccggggccactttcggccctcgggaccaaagtggatatacaaacgaactgtggcgtgcaccatctgtctt

SEQ ID NO: 579658 - DNA, 517 bp, Homo sapiens
  misc_feature: HIJSMM301BGO18.43.81.H04.1.454.light.4.raw
tgtgagtagtcacgaccggtgctcgatttagtagtgtagattcgcgggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccgccctcctcactactca

SEQ ID NO: 579659 - DNA, 490 bp, Homo sapiens; identical to SEQ ID NO: 535234
  misc_feature: HIJSMM301A8NXG.17.21.B10.1.454.light.4.raw

SEQ ID NO: 579660 - DNA, 484 bp, Homo sapiens; identical to SEQ ID NO: 536395
  misc_feature: HIJSMM301ETTEP.46.35.D02.1.454.light.4.raw

SEQ ID NO: 579661 - DNA, 493 bp, Homo sapiens
  misc_feature: HIJSMM301B54FU.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggtcagcctcccaggctcctcatctatggtgaatccaacagggccactggcatcccagacaggttcagtggcaagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatctcccg

SEQ ID NO: 579662 - DNA, 509 bp, Homo sapiens; identical to SEQ ID NO: 557518
  misc_feature: HIJSMM301ALDTH.8.34.D01.1.454.light.4.raw

SEQ ID NO: 579663 - DNA, 487 bp, Homo sapiens; identical to SEQ ID NO: 536206
  misc_feature: HIJSMM301B8PF3.47.38.D05.1.454.light.4.raw

SEQ ID NO: 579664 - DNA, 515 bp, Homo sapiens; identical to SEQ ID NO: 553540
  misc_feature: HIJSMM301EJLA6.22.36.D03.1.454.light.4.raw

SEQ ID NO: 579665 - DNA, 488 bp, Homo sapiens; identical to SEQ ID NO: 542699
  misc_feature: HIJSMM301BLHCZ.12.51.E07.1.454.light.4.raw

SEQ ID NO: 579666 - DNA, 447 bp, Homo sapiens; identical to SEQ ID NO: 535020
  misc_feature: HIJSMM301BL8ST.18.9.A09.1.454.light.4.raw

SEQ ID NO: 579667 - DNA, 499 bp, Homo sapiens
  misc_feature: HIJSMM301EA7OU.48.80.H03.1.454.light.4.raw
agtatacatacacgaccggtgctcgatttagctgtgcgtcgaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagactttttagtttacgtcggaccttcggccaagggacacgactggagattaaacgaactgtggctgcaccatctgtcttcatcttcccg

SEQ ID NO: 579668 - DNA, 506 bp, Homo sapiens
  misc_feature: HIJSMM301DUSIY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggatagatttcactctcaccatcagcagcctgcaggctgaagatgtggcagtttattactgtcaacagttttctcgggcgttcggccaagggaccaaggtggaaagtacaaaacgaactagtggctgcaccatctgtcttcatcttccccg

SEQ ID NO: 579669 - DNA, 497 bp, Homo sapiens; identical to SEQ ID NO: 536376
  misc_feature: HIJSMM301D2A87.22.9.A09.1.454.light.4.raw

SEQ ID NO: 579670 - DNA, 491 bp, Homo sapiens
  misc_feature: HIJSMM301EVDO1.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacggggaccgaccggtcggagtgttcaagcgaactcgtggctgcaccact

SEQ ID NO: 579671 - DNA, 494 bp, Homo sapiens; identical to SEQ ID NO: 536221
  misc_feature: HIJSMM301ERWSV.15.59.F04.1.454.light.4.raw

SEQ ID NO: 579672 - DNA, 494 bp, Homo sapiens; identical to SEQ ID NO: 539894
  misc_feature: HIJSMM301AKMCO.16.53.E09.1.454.light.4.raw

SEQ ID NO: 579673 - DNA, 558 bp, Homo sapiens
  misc_feature: HIJSMM301A9H9R.15.25.C03.1.454.light.4.raw
tctacgtagccacgaccggtgctcgatttagtagtgtagatttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagcccccgtttacactccttcccgccatctgagctacgtagac

SEQ ID NO: 579674 - DNA, 520 bp, Homo sapiens; identical to SEQ ID NO: 539176
  misc_feature: HIJSMM301A4JJI.27.23.C01.1.454.light.4.raw

SEQ ID NO: 579675 - DNA, 494 bp, Homo sapiens; identical to SEQ ID NO: 534994
  misc_feature: HIJSMM301CI339.27.78.H01.1.454.light.4.raw

SEQ ID NO: 579676 - DNA, 520 bp, Homo sapiens
  misc_feature: HIJSMM301AUNC8.41.9.A09.1.454.light.4.raw
tctatactatcacgaccggtgctcgatttagcgagacgcgcagggggtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcgggagggaccaaactgaccgtcctaggtcagcccaaggctgccccctcggtcactctgttcccaccctcctcat

SEQ ID NO: 579677 - DNA, 511 bp, Homo sapiens
  misc_feature: HIJSMM301A4AYA.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggcccctctccctcacttcggcgggggaccgaaggtggagctcaacgaactgtggcgtgcaccactctgtcttctatcttcccg

SEQ ID NO: 579678 - DNA, 491 bp, Homo sapiens
  misc_feature: HIJSMM301CZZ3E.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgttcagcagtataataactggtggacgttcggccaagggaccaaggtagaaatacaaacgaaactgtggctgcaccatctgtt

SEQ ID NO: 579679 - DNA, 492 bp, Homo sapiens; identical to SEQ ID NO: 535972
  misc_feature: HIJSMM301D4FCT.10.77.G11.1.454.light.4.raw

SEQ ID NO: 579680 - DNA, 454 bp, Homo sapiens; identical to SEQ ID NO: 535005
  misc_feature: HIJSMM301B0SHB.19.86.H09.1.454.light.4.raw

SEQ ID NO: 579681 - DNA, 501 bp, Homo sapiens; identical to SEQ ID NO: 536818
  misc_feature: HIJSMM301B4OYZ.12.82.H05.1.454.light.4.raw

SEQ ID NO: 579682 - DNA, 511 bp, Homo sapiens
  misc_feature: HIJSMM301EM8XP.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttggaacaaagctgccctcaccatcacgggggcccaggcagacgatgaatgtgattatcactgcgtcctttatgtggggcgtggcatttgggtgttcgggcggagggaccaaactgaccgtcctaggtcagcccaaggctgccccctcggtcactctcg

SEQ ID NO: 579683 - DNA, 515 bp, Homo sapiens
  misc_feature: HIJSMM301DSCU1.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccgggggccactttcggcccgtcgggaccgaaggtaggagatacaaacgaaactgtggctgcaccatctgtcttcta

SEQ ID NO: 579684 - DNA, 503 bp, Homo sapiens
  misc_feature: HIJSMM301CR5AS.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtctaagtcagcccaaggctgccccctcggtcactctgttcccacct

SEQ ID NO: 579685 - DNA, 496 bp, Homo sapiens
  misc_feature: HIJSMM301AKMZP.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccgaagctggagatcaaacgaactgtggctgcaccatctgtcttcta

SEQ ID NO: 579686 - DNA, 495 bp, Homo sapiens
  misc_feature: HIJSMM301CO82P.53.44.D11.1.454.light.4.raw
cgcgtatacacacgaccggtgctcgatttagcgcagtacgaaggggctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataaccagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtcctaggtcagcccaa

SEQ ID NO: 579687 - DNA, 494 bp, Homo sapiens; identical to SEQ ID NO: 537607
  misc_feature: HIJSMM301ETG9E.52.10.A10.1.454.light.4.raw

SEQ ID NO: 579688 - DNA, 505 bp, Homo sapiens
  misc_feature: HIJSMM301BSCXQ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtacccaacagaaacctggccaggctcccaggcccctcatctatggtgcatccaacagggccactggcatcccagccaggttcagtggcagtggggtctggggacagacttcactctcaccatcatcagcctggagcctgaagatgttgcagtttattactgtcaacatcgtaccgagtggcctccggggccacttcgcctggaccaaacgtggatatcaacgaactagtggcgtgcaccatctgtctt

SEQ ID NO: 579689 - DNA, 505 bp, Homo sapiens; identical to SEQ ID NO: 535503
  misc_feature: HIJSMM301DA5VJ.8.28.C06.1.454.light.4.raw

SEQ ID NO: 579690 - DNA, 481 bp, Homo sapiens
  misc_feature: HIJSMM301ESPD4.16.86.H09.1.454.light.4.raw
  modified_base (455)..(455): a, c, t, g, unknown or other
tgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctcgccccctcggtcactcgtnttccccgccctccgtacagtagtaca

SEQ ID NO: 579691 - DNA, 494 bp, Homo sapiens; identical to SEQ ID NO: 534992
  misc_feature: HIJSMM301C32EX.9.1.A01.1.454.light.4.raw

SEQ ID NO: 579692 - DNA, 491 bp, Homo sapiens
  misc_feature: HIJSMM301AY2BZ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgcaacttactactgtcaacagagttacacgtacccccctcactttcggcggagggaccaaggcggagatcagacgaactgtggctgcaccatctgtcttcta

SEQ ID NO: 579693 - DNA, 486 bp, Homo sapiens
  misc_feature: HIJSMM301A6RBL.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaattagccgggtgggggctgaggatgttggcatttattactgcatgcaggctatacaccttcctgccacttttggccaggggaccaagctggagatcaggcgaa

SEQ ID NO: 579694 - DNA, 504 bp, Homo sapiens
  misc_feature: HIJSMM301CMJJ6.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctcccggtccgaggatggaggctgactattactgtgcatcacgggacgcaacatgggatgacaatctgagcggttgggtgttcggcggagggaccaaactgaccgtcctaggtcagcccaa

SEQ ID NO: 579695 - DNA, 415 bp, Homo sapiens; identical to SEQ ID NO: 535434
  misc_feature: HIJSMM301BKHKJ.16.46.E02.1.454.light.4.raw

SEQ ID NO: 579696 - DNA, 506 bp, Homo sapiens
  misc_feature: HIJSMM301CWR8T.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtatccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcgggcggagggaccaagctgaccgtcctcggtcagcccaaggctgccccctcggtcactctcgttcccaccctcccg

SEQ ID NO: 579697 - DNA, 496 bp, Homo sapiens
  misc_feature: HIJSMM301CFTYS.48.32.C10.1.454.light.4.raw
agtatacatacacgaccggtgctcgatttagtatagacatcaacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggtcagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccaaggtggagatcaaacgaactgtggctgcaccatctgtt

SEQ ID NO: 579698 - DNA, 502 bp, Homo sapiens; identical to SEQ ID NO: 549179
  misc_feature: HIJSMM301CN62X.14.57.F02.1.454.light.4.raw

SEQ ID NO: 579699 - DNA, 494 bp, Homo sapiens; identical to SEQ ID NO: 558961
  misc_feature: HIJSMM301EOM8L.4.82.H05.1.454.light.4.raw

SEQ ID NO: 579700 - DNA, 444 bp, Homo sapiens; identical to SEQ ID NO: 541457
  misc_feature: HIJSMM301C0GKB.7.18.B07.1.454.light.4.raw

SEQ ID NO: 579701 - DNA, 509 bp, Homo sapiens
  misc_feature: HIJSMM301BX40A.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccggtcctacgtcagccc

SEQ ID NO: 579702 - DNA, 478 bp, Homo sapiens
  misc_feature: HIJSMM301CRY2A.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggccaggggaccaagctggagaggaaacgaactagtggctgcaccat

SEQ ID NO: 579703 - DNA, 507 bp, Homo sapiens
  misc_feature: HIJSMM301BFUX4.8.34.D01.1.454.light.4.raw
ctcgcgtgtccacgaccggtgctcgatttagatcgtctgtgttgggtttggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaacgtggatatcaaacgaactgtggctgcaccatctgtcttcta

SEQ ID NO: 579704 - DNA, 514 bp, Homo sapiens
  misc_feature: HIJSMM301C7HKR.48.35.D02.1.454.light.4.raw
agtatacatacacgaccggtgctcgatttagcacacgatagttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaaggctgaccgtcctgggtcagcccaaggctcgccccctcggtcactctgttcccgccct

SEQ ID NO: 579705 - DNA, 477 bp, Homo sapiens
  misc_feature: HIJSMM301ESHS7.5.52.E08.1.454.light.4.raw
atcagacacgcacgaccggtgctcgatttagtcgagctctcagagagaaaggggctgatcaggactcctcagttcaccttctcacaatgaggctccctgctcagctcctggggctgctaatgctctgggtctctggatccagtggggagattgtgctgactcagtctccactctccctgcccgtcacccctggagagccggcctccatctcctgcaggtctagtcagagcctcctgcatagtaatggattcaactatttggattggtacctgcagaggccagggcagtctccacagctcctgatctatttgggctcttatcgggcctccggggtccctgagaggttcagtggcagtggatcaggcacagactttacactgagaatcagcagagtggaggctgaggatgttggggtttattactgcatgcaagctctacaaaccctattcactttcgccctgggaccagagtggataa

SEQ ID NO: 579706 - DNA, 444 bp, Homo sapiens; identical to SEQ ID NO: 535192
  misc_feature: HIJSMM301C5T3Z.5.9.A09.1.454.light.4.raw

SEQ ID NO: 579707 - DNA, 482 bp, Homo sapiens
  misc_feature: HIJSMM301EHASV.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactagtggctgcacc

SEQ ID NO: 579708 - DNA, 522 bp, Homo sapiens
  misc_feature: HIJSMM301DW3CV.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggaccgaacggtaggaaggtacgaaacgaaactacgtaggcgtgtcaccactactgtcttctactcttcccgtccact

SEQ ID NO: 579709 - DNA, 489 bp, Homo sapiens
  misc_feature: HIJSMM301ET7YL.41.23.C01.1.454.light.4.raw
tctatactatcacgaccggtgctcgatttagtacacgtgattagggattgggggctgtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtcctggtcagcccaaggctccg

SEQ ID NO: 579710 - DNA, 510 bp, Homo sapiens
  misc_feature: HIJSMM301C4KG5.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacaatctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaactaagaggtacgaacgaaactagtggctgcaccactctgtcttcatt

SEQ ID NO: 579711 - DNA, 476 bp, Homo sapiens
  misc_feature: HIJSMM301BZIBC.14.5.A05.1.454.light.4.raw
cgtctagtaccacgaccggtgctcgatttagatagatagacagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctctgcgctcactttcggcggagggaccaaggtggagatcaaacgaactagtggctgcaccatctgtcttcatcttcccgccat

SEQ ID NO: 579712 - DNA, 489 bp, Homo sapiens; identical to SEQ ID NO: 535139
  misc_feature: HIJSMM301CO4AP.14.55.E11.1.454.light.4.raw

SEQ ID NO: 579713 - DNA, 483 bp, Homo sapiens
  misc_feature: HIJSMM301B7HFJ.4.6.A06.1.454.light.4.raw
agcactgtagcacgaccggtgctcgatttagatctactgacaggggcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaattatgcatgttggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtgctcatgtggtattcggcggagggaccaagctgaccgtccta

SEQ ID NO: 579714 - DNA, 493 bp, Homo sapiens; identical to SEQ ID NO: 537422
  misc_feature: HIJSMM301EAA0R.9.34.D01.1.454.light.4.raw

SEQ ID NO: 579715 - DNA, 494 bp, Homo sapiens; identical to SEQ ID NO: 540664
  misc_feature: HIJSMM301BJ3NR.47.64.F09.1.454.light.4.raw

SEQ ID NO: 579716 - DNA, 484 bp, Homo sapiens; identical to SEQ ID NO: 535240
  misc_feature: HIJSMM301EA5V4.47.60.F05.1.454.light.4.raw

SEQ ID NO: 579717 - DNA, 510 bp, Homo sapiens
  misc_feature: HIJSMM301BB112.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcacttctcaccatcagcagcctgcaggctgaagatgtggcagtttattactgtcaacagttttctcggggcgttcggccaagggaccgaaggtaggaaatacaaacgaactagtggctgcaccactctgtcttctatcttccccg

SEQ ID NO: 579718 - DNA, 487 bp, Homo sapiens; identical to SEQ ID NO: 541729
  misc_feature: HIJSMM301A1KYS.40.83.H06.1.454.light.4.raw

SEQ ID NO: 579719 - DNA, 495 bp, Homo sapiens; identical to SEQ ID NO: 555142
  misc_feature: HIJSMM301AYV0W.9.1.A01.1.454.light.4.raw

SEQ ID NO: 579720 - DNA, 493 bp, Homo sapiens; identical to SEQ ID NO: 544335
  misc_feature: HIJSMM301DYS11.5.57.F02.1.454.light.4.raw

SEQ ID NO: 579721 - DNA, 508 bp, Homo sapiens; identical to SEQ ID NO: 550253
  misc_feature: HIJSMM301BC0EN.9.55.E11.1.454.light.4.raw

SEQ ID NO: 579722 - DNA, 487 bp, Homo sapiens
  misc_feature: HIJSMM301CA2T4.52.3.A03.1.454.light.4.raw
cgcagtacgacacgaccggtgctcgatttagagagcgtcacagggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaagcccctaaactcctgatctctaaggcatctgatttacaaactggggtcccgtcaaggttcagcggcagtggatctgggacagacttcactctcacatcagcagcctgcagcctgatgactttgcaagttattattgccaacagtataacagtttttcatttcacttttggccctgggacgacagtggatatcaaacgaactgtggctgcaccatctgtcttcta

SEQ ID NO: 579723 - DNA, 454 bp, Homo sapiens; identical to SEQ ID NO: 534964
  misc_feature: HIJSMM301B0DV0.19.86.H09.1.454.light.4.raw

SEQ ID NO: 579724 - DNA, 499 bp, Homo sapiens
  misc_feature: HIJSMM301DNRGD.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttatactgtcagcaatattatattcctcctcagacgttcggccaagggaccaaggtggaaaatcaaacgaactgtggctgcacca

SEQ ID NO: 579725 - DNA, 441 bp, Homo sapiens; identical to SEQ ID NO: 534971
  misc_feature: HIJSMM301DKUWR.11.3.A03.1.454.light.4.raw

SEQ ID NO: 579726 - DNA, 497 bp, Homo sapiens; identical to SEQ ID NO: 545672
  misc_feature: HIJSMM301CGM2D.2.49.E05.1.454.light.4.raw

SEQ ID NO: 579727 - DNA, 506 bp, Homo sapiens; identical to SEQ ID NO: 534969
  misc_feature: HIJSMM301C8PAN.18.37.D04.1.454.light.4.raw

SEQ ID NO: 579728 - DNA, 491 bp, Homo sapiens; identical to SEQ ID NO: 535176
  misc_feature: HIJSMM301DN7YB.13.39.D06.1.454.light.4.raw

SEQ ID NO: 579729 - DNA, 481 bp, Homo sapiens; identical to SEQ ID NO: 535993
  misc_feature: HIJSMM301CNW4M.21.25.C03.1.454.light.4.raw

SEQ ID NO: 579730 - DNA, 476 bp, Homo sapiens; identical to SEQ ID NO: 538026
  misc_feature: HIJSMM301AVZN6.13.76.G10.1.454.light.4.raw

SEQ ID NO: 579731 - DNA, 495 bp, Homo sapiens
  misc_feature: HIJSMM301EDLOC.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggctccctgaccgtctctgggctccaggctgaggatgaggctgattattactgcagctcatatgcaggcagcagcagtccccatgtgatcttcggcggggggaccaagctgaccgtcctaggtcagccc

SEQ ID NO: 579732 - DNA, 485 bp, Homo sapiens
  misc_feature: HIJSMM301D5C0G.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagaccctgccactttcggccctgggaccatagtggatatgaaacgaactgtggctgcacc

SEQ ID NO: 579733 - DNA, 489 bp, Homo sapiens; identical to SEQ ID NO: 535139
  misc_feature: HIJSMM301AQA2P.14.55.E11.1.454.light.4.raw

SEQ ID NO: 579734 - DNA, 514 bp, Homo sapiens
  misc_feature: HIJSMM301BA5X3.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcggatccctgatcgcttctcgggctccagctctggggccagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccacctcctcacg

SEQ ID NO: 579735 - DNA, 489 bp, Homo sapiens; identical to SEQ ID NO: 535139
  misc_feature: HIJSMM301AZLOV.14.55.E11.1.454.light.4.raw

SEQ ID NO: 579736 - DNA, 489 bp, Homo sapiens
  misc_feature: HIJSMM301DDH6N.51.41.D08.1.454.light.4.raw
cgatcgtatacacgaccggtgctcgatttagtcacgcgagaaagggaaagggggcaggagtcagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggacaaatttttctttcaccatcaccaacctgcaacctgaggattttgcaacatatttctgtcaacaatatgataatgtccccaccgtcactttcggcggagggaccaaggtggacctcaaacgaactgtggctgcacc

SEQ ID NO: 579737 - DNA, 498 bp, Homo sapiens
  misc_feature: HIJSMM301EM4AS.52.29.C07.1.454.light.4.raw
cgcagtacgacacgaccggtgctcgatttagagtgctacgaagggaaagggggtgggtccaggaggcagaactctgggtgtctcaccattgcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccactgtcactctcg

SEQ ID NO: 579738 - DNA, 503 bp, Homo sapiens
  misc_feature: HIJSMM301A8S97.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctgcctccaagtctggcaacacggcctcctgacaatctctgggctccaggctgacgacgaggctgaatattactgcagctcatatgtagatggtgcctctttcaaggttttcggcggagggaccaggctgaccgtcctaagtcagcccaaggctgccccctcggtcact

SEQ ID NO: 579739 - DNA, 474 bp, Homo sapiens
  misc_feature: HIJSMM301EDVUS.48.61.F06.1.454.light.4.raw
  modified_base (458)..(458): a, c, t, g, unknown or other
agtatacatacacgaccggtgctcgatttagctacgctctaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtctcggaactganaccaaggtcaccgtct

SEQ ID NO: 579740 - DNA, 470 bp, Homo sapiens
  misc_feature: HIJSMM301CYSIA.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatacaaacgaa

SEQ ID NO: 579741 - DNA, 447 bp, Homo sapiens; identical to SEQ ID NO: 535201
  misc_feature: HIJSMM301D3UHW.18.9.A09.1.454.light.4.raw

SEQ ID NO: 579742 - DNA, 484 bp, Homo sapiens
  misc_feature: HIJSMM301DR44A.49.37.D04.1.454.light.4.raw
agtcgagagacacgaccggtgctcgatttagtagcatactgttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaac

SEQ ID NO: 579743 - DNA, 488 bp, Homo sapiens
  misc_feature: HIJSMM301B8NGO.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 579744 - DNA, 502 bp, Homo sapiens; identical to SEQ ID NO: 537363
  misc_feature: HIJSMM301D4DNR.18.23.C01.1.454.light.4.raw

SEQ ID NO: 579745 - DNA, 477 bp, Homo sapiens
  misc_feature: HIJSMM301A5QST.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccgaaggtaggaaagtacaaacgaactagtggc

SEQ ID NO: 579746 - DNA, 499 bp, Homo sapiens; identical to SEQ ID NO: 560695
  misc_feature: HIJSMM301C3UVH.2.34.D01.1.454.light.4.raw

SEQ ID NO: 579747 - DNA, 521 bp, Homo sapiens; identical to SEQ ID NO: 538715
  misc_feature: HIJSMM301A73V5.27.23.C01.1.454.light.4.raw

SEQ ID NO: 579748 - DNA, 485 bp, Homo sapiens; identical to SEQ ID NO: 573950
  misc_feature: HIJSMM301DTMWQ.49.3.A03.1.454.light.4.raw

SEQ ID NO: 579749 - DNA, 493 bp, Homo sapiens
  misc_feature: HIJSMM301C8MLI.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgctaacttactactgtcaacagagttacacgtacccccctcactttcggcggagggaccgaaggcggagatcagacgaactgtggctgcaccatctgtcttcta

SEQ ID NO: 579750 - DNA, 503 bp, Homo sapiens; identical to SEQ ID NO: 552945
  misc_feature: HIJSMM301CLWSJ.17.61.F06.1.454.light.4.raw

SEQ ID NO: 579751 - DNA, 508 bp, Homo sapiens
  misc_feature: HIJSMM301B62AS.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgctagtttatttctgtcagcagtctgaagactggccgttctactttcggcggagggaccgaaggtggacctcaaacgaactgtggctgcaccatctgtcttcatccttcccgc

SEQ ID NO: 579752 - DNA, 498 bp, Homo sapiens
  misc_feature: HIJSMM301B6RM0.48.60.F05.1.454.light.4.raw
agtatacatacacgaccggtgctcgatttagtacgtcatcagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaaggacacgactggagattaacgaactgtggctgcaccatctgtcttctactcttcccg

SEQ ID NO: 579753 - DNA, 484 bp, Homo sapiens; identical to SEQ ID NO: 535240
  misc_feature: HIJSMM301CIBWW.47.60.F05.1.454.light.4.raw

SEQ ID NO: 579754 - DNA, 513 bp, Homo sapiens
  misc_feature: HIJSMM301DUCDH.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatactttttgtcttcggaactgggaccaaggtcaccgtcctaggtcagcccaaggccaaccccactgtcactcttcg

SEQ ID NO: 579755 - DNA, 491 bp, Homo sapiens
  misc_feature: HIJSMM301CFZWL.21.9.A09.1.454.light.4.raw
tcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggggggcagagtctccatcacttgccgggccagtcagaatatttatagctggttggcctggtatcagcagaaaccagggaaagcccctaacctcctgatatatcgggcgtctaatttagaaagtggggtcccatcgaggttcagcggcagtggctctgggacagaattcactctcaccatcagcggcctgcagcccgatgattttgcaacttattactgccaacattacaatgattactcgcgtacgttcggccaagggaccagggtggaaatcaaacgaactgtggctgcaccatctgtcttcat

SEQ ID NO: 579756 - DNA, 488 bp, Homo sapiens; identical to SEQ ID NO: 535568
  misc_feature: HIJSMM301BA6TV.21.4.A04.1.454.light.4.raw

SEQ ID NO: 579757 - DNA, 478 bp, Homo sapiens
  misc_feature: HIJSMM301CMC6Q.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatctttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaact

SEQ ID NO: 579758 - DNA, 502 bp, Homo sapiens; identical to SEQ ID NO: 539314
  misc_feature: HIJSMM301A1F6W.21.81.H04.1.454.light.4.raw

SEQ ID NO: 579759 - DNA, 447 bp, Homo sapiens; identical to SEQ ID NO: 535882
  misc_feature: HIJSMM301DIW81.18.9.A09.1.454.light.4.raw
  modified_base (429)..(429): a, c, t, g, unknown or other

SEQ ID NO: 579760 - DNA, 487 bp, Homo sapiens
  misc_feature: HIJSMM301B2LRK.49.55.E11.1.454.light.4.raw
agtcgagagacacgaccggtgctcgatttagcactcgcacgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcggcagcctgcagactgaagatgtggcagtgtattactgtcagcaatatcacactgctccgctcactttcggcggagggaccagggtggagatcaaacgaac

SEQ ID NO: 579761 - DNA, 512 bp, Homo sapiens
  misc_feature: HIJSMM301EA5V8.48.34.D01.1.454.light.4.raw
agtatacatacacgaccggtgctcgatttagatcgtctgtgttgggtttggggggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccctcct

SEQ ID NO: 579762 - DNA, 500 bp, Homo sapiens
  misc_feature: HIJSMM301DIAW8.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcgggagggaccaagctgaccgtcctaggtcagcccaaggctcgccccccg

SEQ ID NO: 579763 - DNA, 487 bp, Homo sapiens; identical to SEQ ID NO: 539717
  misc_feature: HIJSMM301C1ACD.26.55.E11.1.454.light.4.raw

SEQ ID NO: 579764 - DNA, 462 bp, Homo sapiens
  misc_feature: HIJSMM301BF6UC.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 579765 - DNA, 497 bp, Homo sapiens
  misc_feature: HIJSMM301D5B4P.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 579766 - DNA, 495 bp, Homo sapiens; identical to SEQ ID NO: 535486
  misc_feature: HIJSMM301CJUPB.26.72.G06.1.454.light.4.raw

SEQ ID NO: 579767 - DNA, 495 bp, Homo sapiens
  misc_feature: HIJSMM301ECX93.17.40.D07.1.454.light.4.raw
cgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgcccgggcagttcccctagaactgtgatctatgaagatactgtcagaccctccgggatccctgatcggttctctggctccgtcgacagttcctccaactctgcctccctcaccatctctggactgacgactgaggacgagggtgactactactgtcactcttatgatgacatttatgaggcgatattcggcggagggacaaaggtgaccgtgctaggtcagaccccg

SEQ ID NO: 579768 - DNA, 509 bp, Homo sapiens
  misc_feature: HIJSMM301EQ212.43.3.A03.1.454.light.4.raw
tgtgagtagtcacgaccggtgctcgatttagagagcgtcacagggggtggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccacactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctcggtcactctgtccccg

SEQ ID NO: 579769 - DNA, 487 bp, Homo sapiens; identical to SEQ ID NO: 576073
  misc_feature: HIJSMM301CSW05.22.73.G07.1.454.light.4.raw

SEQ ID NO: 579770 - DNA, 500 bp, Homo sapiens; identical to SEQ ID NO: 540012
  misc_feature: HIJSMM301BU7O2.52.34.D01.1.454.light.4.raw

SEQ ID NO: 579771 - DNA, 489 bp, Homo sapiens
  misc_feature: HIJSMM301EO9ED.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcactttcggcggagggccaaaggtggagatcaagcgaactgtggctgcaccatctgtctt

SEQ ID NO: 579772 - DNA, 489 bp, Homo sapiens; identical to SEQ ID NO: 535139
  misc_feature: HIJSMM301AML0Q.14.55.E11.1.454.light.4.raw

SEQ ID NO: 579773 - DNA, 495 bp, Homo sapiens
  misc_feature: HIJSMM301BSAZ7.40.57.F02.1.454.light.4.raw
tctagcgactcacgaccggtgctcgatttagctcgatatagttgggtttggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaac

SEQ ID NO: 579774 - DNA, 486 bp, Homo sapiens; identical to SEQ ID NO: 535043
  misc_feature: HIJSMM301D50WU.46.35.D02.1.454.light.4.raw

SEQ ID NO: 579775 - DNA, 495 bp, Homo sapiens
  misc_feature: HIJSMM301E0VI0.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggatccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttccca

SEQ ID NO: 579776 - DNA, 516 bp, Homo sapiens
  misc_feature: HIJSMM301CSAS0.40.74.G08.1.454.light.4.raw
tctagcgactcacgaccggtgctcgatttagtagctctatcgagggggggggaagctcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggcccctggggtccctgaccgaatctctggctccaggtctggcgcctcagcctccctggtcattagtgggctccagtctgacgatgaggctgactattactgttcagcgtggatgccagcccgaatcattgggtgttcggcggagggaccaaactgaccgtcctaggtcagcccaaggctgccccctcggt

SEQ ID NO: 579777 - DNA, 495 bp, Homo sapiens; identical to SEQ ID NO: 567872
  misc_feature: HIJSMM301C4HI4.3.33.C11.1.454.light.4.raw

SEQ ID NO: 579778 - DNA, 506 bp, Homo sapiens; identical to SEQ ID NO: 539705
  misc_feature: HIJSMM301BJ34M.40.67.G01.1.454.light.4.raw

SEQ ID NO: 579779 - DNA, 499 bp, Homo sapiens
  misc_feature: HIJSMM301CHJUZ.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagccaaggctgcccctcggtcactctcg

SEQ ID NO: 579780 - DNA, 495 bp, Homo sapiens
  misc_feature: HIJSMM301D44PM.51.39.D06.1.454.light.4.raw
cgatcgtatacacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtcaccgtcctaggtcagcccaaggccaacccatgtcact

SEQ ID NO: 579781 - DNA, 494 bp, Homo sapiens; identical to SEQ ID NO: 545188
  misc_feature: HIJSMM301B9FLO.10.79.H02.1.454.light.4.raw

SEQ ID NO: 579782 - DNA, 499 bp, Homo sapiens
  misc_feature: HIJSMM301BONBC.7.5.A05.1.454.light.4.raw
  modified_base (317)..(317): a, c, t, g, unknown or other
cgtgtctctacacgaccggtgctcgatttagatagatagacaggggggggtcgtcaggaggcagcgctctcgggacgtctccaccatggcctgggctctgctattcctcaccctcctaacactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttnaggggtttccaatcgcttctctggctccaagtctggcgacacggcctccctgaccatctctgggctccaggctgaagacgaggctgattattactgcagctcatatacaggcagcagcactcaggttttcggcggaggaccaagctgaccgtcctaggtcagcccaaggctgccccctcggt

SEQ ID NO: 579783 - DNA, 503 bp, Homo sapiens; identical to SEQ ID NO: 551912
  misc_feature: HIJSMM301D35AN.12.50.E06.1.454.light.4.raw

SEQ ID NO: 579784 - DNA, 501 bp, Homo sapiens; identical to SEQ ID NO: 535746
  misc_feature: HIJSMM301AY52Q.18.11.A11.1.454.light.4.raw

SEQ ID NO: 579785 - DNA, 477 bp, Homo sapiens
  misc_feature: HIJSMM301CSPHK.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagccctaagctcctgatctatgctgcatccagtttgcaaagtggggtcccatcaaggttcagtggcagtggatctgggacagatttcactctcaccatcaacagtctgcaacctgaagtattttgcaacttactactgtacaacagagtttcactacccctctctacgtttcggcgggggaccgaaggtggagatacaaacgaa

SEQ ID NO: 579786 - DNA, 486 bp, Homo sapiens; identical to SEQ ID NO: 572465
  misc_feature: HIJSMM301AMU21.41.33.C11.1.454.light.4.raw

SEQ ID NO: 579787 - DNA, 503 bp, Homo sapiens; identical to SEQ ID NO: 555463
  misc_feature: HIJSMM301DK8S1.43.14.B03.1.454.light.4.raw

SEQ ID NO: 579788 - DNA, 502 bp, Homo sapiens; identical to SEQ ID NO: 536253
  misc_feature: HIJSMM301A11TI.21.22.B11.1.454.light.4.raw

SEQ ID NO: 579789 - DNA, 499 bp, Homo sapiens; identical to SEQ ID NO: 555466
  misc_feature: HIJSMM301BZ9WQ.43.35.D02.1.454.light.4.raw

SEQ ID NO: 579790 - DNA, 462 bp, Homo sapiens; identical to SEQ ID NO: 542244
  misc_feature: HIJSMM301CHIQY.49.73.G07.1.454.light.4.raw

SEQ ID NO: 579791 - DNA, 490 bp, Homo sapiens; identical to SEQ ID NO: 544430
  misc_feature: HIJSMM301C1EDR.10.20.B09.1.454.light.4.raw

SEQ ID NO: 579792 - DNA, 512 bp, Homo sapiens
  misc_feature: HIJSMM301EJA5C.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccgaagggaccgaaggtaggaaagtacaaacgaactagtggctgcaccatctgtcttctactcttccccg

SEQ ID NO: 579793 - DNA, 519 bp, Homo sapiens
  misc_feature: HIJSMM301DTUZP.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgtctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccact

SEQ ID NO: 579794 - DNA, 499 bp, Homo sapiens; identical to SEQ ID NO: 543922
  misc_feature: HIJSMM301CSKJY.18.11.A11.1.454.light.4.raw

SEQ ID NO: 579795 - DNA, 469 bp, Homo sapiens
  misc_feature: HIJSMM301CU6Q1.51.87.H10.1.454.light.4.raw
cgatcgtatacacgaccggtgctcgatttagcagtactgcgttgggtttgggggtcagtcccaaccaggacacagcatggacatgagggtccctgctcagctcctggggctcctgctgctctggctctcaggtgccagatgtgtcatccagatgacccagtctccatcctccttgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgataagtctcccgctcactttcggcggggggaccgaaggtggagatcaagcgaa

SEQ ID NO: 579796 - DNA, 514 bp, Homo sapiens
  misc_feature: HIJSMM301COFWX.2.34.D01.1.454.light.4.raw
  modified_base (505)..(505): a, c, t, g, unknown or other
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatggaggctgatttattactgcagctcatatgcaggcagcaacaatgtggcagttcggcggagggaccaagctgaccgtccgtgggtcacgacccgaaggctcgccccctcggtcactctcgttccccaccctcctctgtcgngcgtctgac

SEQ ID NO: 579797 - DNA, 521 bp, Homo sapiens
  misc_feature: HIJSMM301DB6BZ.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccaccctcctccgt

SEQ ID NO: 579798 - DNA, 500 bp, Homo sapiens
  misc_feature: HIJSMM301CCL7Z.48.43.D10.1.454.light.4.raw
agtatacatacacgaccggtgctcgatttagactagcagtaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaaacgaactgtggctgcaccatctgtcttcatcttcccgccta

SEQ ID NO: 579799 - DNA, 517 bp, Homo sapiens
  misc_feature: HIJSMM301B1I94.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgatttttggaaattttgacctagtctcctggtaccaacaatacccggcaaagtccccaagttaatcatttatgagggcactaagcggccctcaggagtttctgatcgcttctctggctccaaggctggcgaccgggctccctgacaatatctgggctccaggctgaggacgaggctcattactactgctgctcatatggaggttatagcacttgggtgttcggcggcgggaccaaagtgaccgtcctaagtcagccaaggctgcccctcggtcactctcgttccacct

SEQ ID NO: 579800 - DNA, 441 bp, Homo sapiens; identical to SEQ ID NO: 535074
  misc_feature: HIJSMM301EKSKO.11.3.A03.1.454.light.4.raw

SEQ ID NO: 579801 - DNA, 494 bp, Homo sapiens; identical to SEQ ID NO: 562585
  misc_feature: HIJSMM301D0KFZ.15.59.F04.1.454.light.4.raw
  modified_base (476)..(476): a, c, t, g, unknown or other

SEQ ID NO: 579802 - DNA, 488 bp, Homo sapiens; identical to SEQ ID NO: 539612
  misc_feature: HIJSMM301DWU6Q.3.55.E11.1.454.light.4.raw

SEQ ID NO: 579803 - DNA, 498 bp, Homo sapiens
  misc_feature: HIJSMM301CXBHB.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcacgtcctacgtcagcccaaggccaacccactgtca

SEQ ID NO: 579804 - DNA, 506 bp, Homo sapiens
  misc_feature: HIJSMM301EWVF5.40.45.E01.1.454.light.4.raw
tctagcgactcacgaccggtgctcgatttagtgagtcagtaagggaaagggggaggaactgctcagttaggacccagagggaaccatggaagccccagctcagcttctcttcctcctgctactctggctcccagtaatcaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccgctcactttcggcggagggaccaaggtggagatacaaacgaactgtggctgcaccatctgtcttcatccttccccg

SEQ ID NO: 579805 - DNA, 509 bp, Homo sapiens
  misc_feature: HIJSMM301CKR81.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactctgtcgtttggtgttcggcggagggccaagttgaccgtctaggtcagcccaaggctgccccctggtcactctgttcccccg

SEQ ID NO: 579806 - DNA, 508 bp, Homo sapiens; identical to SEQ ID NO: 540640
  misc_feature: HIJSMM301C9NP1.5.60.F05.1.454.light.4.raw

SEQ ID NO: 579807 - DNA, 493 bp, Homo sapiens
  misc_feature: HIJSMM301CA3ST.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggccaggggaccaagctggagatcaaacgaactgtggctgcaccatctgtctt

SEQ ID NO: 579808 - DNA, 441 bp, Homo sapiens; identical to SEQ ID NO: 534971
  misc_feature: HIJSMM301DNGQ5.11.3.A03.1.454.light.4.raw

SEQ ID NO: 579809 - DNA, 514 bp, Homo sapiens
  misc_feature: HIJSMM301BJS5L.15.86.H09.1.454.light.4.raw
tctacgtagccacgaccggtgctcgatttagtgctatagacttgggtttggggggacttccctggtctccttctacctactgcccttcatttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgtagac

SEQ ID NO: 579810 - DNA, 486 bp, Homo sapiens; identical to SEQ ID NO: 535043
  misc_feature: HIJSMM301AXITE.46.35.D02.1.454.light.4.raw

SEQ ID NO: 579811 - DNA, 478 bp, Homo sapiens
  misc_feature: HIJSMM301CWS6B.49.26.C04.1.454.light.4.raw
agtcgagagacacgaccggtgctcgatttagtctagcgactttgggtttggggggaactgctcagttaggacccagacggaaccatggaagctccagcgcagcttctcttcctcctgctactctggctcccagataccactggagaaatagtgatgacgcagtctccagccaccctgtctgtgtctccaggggaaagagtcaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtgg

SEQ ID NO: 579812 - DNA, 487 bp, Homo sapiens; identical to SEQ ID NO: 538190
  misc_feature: HIJSMM301DA1I4.47.70.G04.1.454.light.4.raw

SEQ ID NO: 579813 - DNA, 496 bp, Homo sapiens
  misc_feature: HIJSMM301CQWG5.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgactgtggctgcaccatctgtcttca

SEQ ID NO: 579814 - DNA, 514 bp, Homo sapiens; identical to SEQ ID NO: 572132
  misc_feature: HIJSMM301CZJJJ.43.59.F04.1.454.light.4.raw

SEQ ID NO: 579815 - DNA, 490 bp, Homo sapiens; identical to SEQ ID NO: 535234
  misc_feature: HIJSMM301BOR0A.17.21.B10.1.454.light.4.raw

SEQ ID NO: 579816 - DNA, 507 bp, Homo sapiens; identical to SEQ ID NO: 535641
  misc_feature: HIJSMM301EDMHJ.10.88.H11.1.454.light.4.raw

SEQ ID NO: 579817 - DNA, 505 bp, Homo sapiens; identical to SEQ ID NO: 535503
  misc_feature: HIJSMM301C8USV.8.28.C06.1.454.light.4.raw

SEQ ID NO: 579818 - DNA, 521 bp, Homo sapiens; identical to SEQ ID NO: 539470
  misc_feature: HIJSMM301BM5JE.27.23.C01.1.454.light.4.raw

SEQ ID NO: 579819 - DNA, 508 bp, Homo sapiens; identical to SEQ ID NO: 536388
  misc_feature: HIJSMM301C6IY7.11.57.F02.1.454.light.4.raw

SEQ ID NO: 579820 - DNA, 517 bp, Homo sapiens
  misc_feature: HIJSMM301EG8O9.49.35.D02.1.454.light.4.raw
agtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctgttccca

SEQ ID NO: 579821 - DNA, 494 bp, Homo sapiens; identical to SEQ ID NO: 542264
  misc_feature: HIJSMM301COGR7.13.6.A06.1.454.light.4.raw

SEQ ID NO: 579822 - DNA, 482 bp, Homo sapiens
  misc_feature: HIJSMM301CIZ1G.41.36.D03.1.454.light.4.raw
tctatactatcacgaccggtgctcgatttagctgcgtcacgatctctcttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacaccgcctccctgaccattactggactccaacctgaggacgaggctgactattattgctcagcatgggacaccagcctcaatgccgcggtattcggcgcagggaccaagctgaccgtcctac

SEQ ID NO: 579823 - DNA, 486 bp, Homo sapiens; identical to SEQ ID NO: 535043
  misc_feature: HIJSMM301DZBRI.46.35.D02.1.454.light.4.raw

SEQ ID NO: 579824 - DNA, 489 bp, Homo sapiens
  misc_feature: HIJSMM301DQRWM.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcacttttcggccaagggacacgaccgcagattggacgaactgtggctgcacc

SEQ ID NO: 579825 - DNA, 489 bp, Homo sapiens; identical to SEQ ID NO: 535139
  misc_feature: HIJSMM301BJL16.14.55.E11.1.454.light.4.raw

SEQ ID NO: 579826 - DNA, 530 bp, Homo sapiens
  misc_feature: HIJSMM301C9Z8Z.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcgaggtcagccccaaggcctggccccctccggtcactcctcgttcccacccctccctcctacccg

SEQ ID NO: 579827 - DNA, 490 bp, Homo sapiens
  misc_feature: HIJSMM301CWOIZ.43.36.D03.1.454.light.4.raw
  modified_base (310)..(310): a, c, t, g, unknown or other
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccaccatcagcacgccttagcctggtaccagcacaagtcagggcagcctcctaagttgctcttttacnggacttcgatccgcgcatctggggtccctgaccgattcatgggcagcggctctgggacagacttcgctctcaccatcaacagcctccaggctggaggatgcggcggtttattattgtcaacaattattttagtgctccgtactacttttggccaggggaccaaggttggagatcaaacga

SEQ ID NO: 579828 - DNA, 500 bp, Homo sapiens
  misc_feature: HIJSMM301D5Z3H.13.81.H04.1.454.light.4.raw
tcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattgctgtttgacttggcacaacaacgcctggatcttcggacctgggaccacggtcaccgtcctaggtcagcccaaggccaaccccactgtcact

SEQ ID NO: 579829 - DNA, 521 bp, Homo sapiens
  misc_feature: HIJSMM301BBHH9.27.23.C01.1.454.light.4.raw
agcgtcgtctcacgaccggtgctcgatttagtacacgtgattagggagttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcgggcggagggaccaggctgaccgtcctaggtcagcccaaggctgccccctcggtcactctgttcccaccct

SEQ ID NO: 579830 - DNA, 497 bp, Homo sapiens; identical to SEQ ID NO: 535664
  misc_feature: HIJSMM301ASF1G.22.14.B03.1.454.light.4.raw

SEQ ID NO: 579831 - DNA, 509 bp, Homo sapiens
  misc_feature: HIJSMM301CDQDX.40.48.E04.1.454.light.4.raw
tctagcgactcacgaccggtgctcgatttagagagcgtcacagagagaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgcccctcggtcactctcg

SEQ ID NO: 579832 - DNA, 496 bp, Homo sapiens
  misc_feature: HIJSMM301D4WF6.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggcctaggggaccaagctggagatcaaaacgaactgtggc

SEQ ID NO: 579833 - DNA, 494 bp, Homo sapiens; identical to SEQ ID NO: 559643
  misc_feature: HIJSMM301C8XPN.27.78.H01.1.454.light.4.raw

SEQ ID NO: 579834 - DNA, 491 bp, Homo sapiens
  misc_feature: HIJSMM301DCIYJ.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcacatctgtctt

SEQ ID NO: 579835 - DNA, 482 bp, Homo sapiens
  misc_feature: HIJSMM301AQF3B.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgaggcagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggctcagtgcgtgggttttcggcggagggaccaagctgaccgtcctaggtcagcccg

SEQ ID NO: 579836 - DNA, 508 bp, Homo sapiens; identical to SEQ ID NO: 535835
  misc_feature: HIJSMM301CYY1E.8.34.D01.1.454.light.4.raw

SEQ ID NO: 579837 - DNA, 507 bp, Homo sapiens
  misc_feature: HIJSMM301D3QEO.48.35.D02.1.454.light.4.raw
agtatacatacacgaccggtgctcgatttagcacacgatagttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctcgtt

SEQ ID NO: 579838 - DNA, 494 bp, Homo sapiens; identical to SEQ ID NO: 534992
  misc_feature: HIJSMM301ER02G.9.1.A01.1.454.light.4.raw

SEQ ID NO: 579839 - DNA, 522 bp, Homo sapiens; identical to SEQ ID NO: 539966
  misc_feature: HIJSMM301BN7NM.27.23.C01.1.454.light.4.raw

SEQ ID NO: 579840 - DNA, 497 bp, Homo sapiens; identical to SEQ ID NO: 539718
  misc_feature: HIJSMM301E3FQJ.40.54.E10.1.454.light.4.raw

SEQ ID NO: 579841 - DNA, 508 bp, Homo sapiens
  misc_feature: HIJSMM301B0GR4.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagcccaccctggccatcagtgggctccggcccgaggatgaggctgattattactgtgtaggttgggatcgcagcctgactgcttacgtcttcggagctgggaccaaggtcaccgtcctaggtcagcccaaggccaacccc

SEQ ID NO: 579842 - DNA, 489 bp, Homo sapiens; identical to SEQ ID NO: 540247
  misc_feature: HIJSMM301ELUPV.48.75.G09.1.454.light.4.raw

SEQ ID NO: 579843 - DNA, 481 bp, Homo sapiens; identical to SEQ ID NO: 539249
  misc_feature: HIJSMM301CO84D.11.76.G10.1.454.light.4.raw

SEQ ID NO: 579844 - DNA, 507 bp, Homo sapiens
  misc_feature: HIJSMM301EO7KM.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 579845 - DNA, 469 bp, Homo sapiens; identical to SEQ ID NO: 536091
  misc_feature: HIJSMM301D27TG.3.82.H05.1.454.light.4.raw

SEQ ID NO: 579846 - DNA, 502 bp, Homo sapiens; identical to SEQ ID NO: 557385
  misc_feature: HIJSMM301D2RQV.40.23.C01.1.454.light.4.raw

SEQ ID NO: 579847 - DNA, 522 bp, Homo sapiens
  misc_feature: HIJSMM301EVW9D.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccctccta

SEQ ID NO: 579848 - DNA, 495 bp, Homo sapiens
  misc_feature: HIJSMM301DCYFG.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 579849 - DNA, 522 bp, Homo sapiens; identical to SEQ ID NO: 544405
  misc_feature: HIJSMM301EK4SY.27.23.C01.1.454.light.4.raw

SEQ ID NO: 579850 - DNA, 521 bp, Homo sapiens; identical to SEQ ID NO: 538715
  misc_feature: HIJSMM301EGC3O.27.23.C01.1.454.light.4.raw

SEQ ID NO: 579851 - DNA, 484 bp, Homo sapiens; identical to SEQ ID NO: 535441
  misc_feature: HIJSMM301BU4PM.26.60.F05.1.454.light.4.raw

SEQ ID NO: 579852 - DNA, 504 bp, Homo sapiens; identical to SEQ ID NO: 535935
  misc_feature: HIJSMM301DOOEK.18.78.H01.1.454.light.4.raw

SEQ ID NO: 579853 - DNA, 482 bp, Homo sapiens
  misc_feature: HIJSMM301EKCEA.52.72.G06.1.454.light.4.raw
cgcagtacgacacgaccggtgctcgatttagctacgactgcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccgaaggtggagatcaaacgaactgtggctgcacc

SEQ ID NO: 579854 - DNA, 521 bp, Homo sapiens; identical to SEQ ID NO: 539470
  misc_feature: HIJSMM301BJTH6.27.23.C01.1.454.light.4.raw

SEQ ID NO: 579855 - DNA, 497 bp, Homo sapiens; identical to SEQ ID NO: 536371
  misc_feature: HIJSMM301CVE3N.16.78.H01.1.454.light.4.raw

SEQ ID NO: 579856 - DNA, 507 bp, Homo sapiens; identical to SEQ ID NO: 561702
  misc_feature: HIJSMM301AOX8U.5.24.C02.1.454.light.4.raw

SEQ ID NO: 579857 - DNA, 508 bp, Homo sapiens; identical to SEQ ID NO: 536521
  misc_feature: HIJSMM301CZI6R.17.33.C11.1.454.light.4.raw

SEQ ID NO: 579858 - DNA, 486 bp, Homo sapiens; identical to SEQ ID NO: 537428
  misc_feature: HIJSMM301AHKV9.47.62.F07.1.454.light.4.raw

SEQ ID NO: 579859 - DNA, 505 bp, Homo sapiens
  misc_feature: HIJSMM301BD33E.48.23.C01.1.454.light.4.raw
agtatacatacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaaagctgaccgtcctaagtcagcccaaggctgccccctcggtcactcttcg

SEQ ID NO: 579860 - DNA, 485 bp, Homo sapiens; identical to SEQ ID NO: 544293
  misc_feature: HIJSMM301C2OIJ.26.70.G04.1.454.light.4.raw

SEQ ID NO: 579861 - DNA, 505 bp, Homo sapiens; identical to SEQ ID NO: 535987
  misc_feature: HIJSMM301ATNPO.18.37.D04.1.454.light.4.raw

SEQ ID NO: 579862 - DNA, 496 bp, Homo sapiens
  misc_feature: HIJSMM301ENGC3.48.37.D04.1.454.light.4.raw
agtatacatacacgaccggtgctcgatttagtagcatactgttgggtttggggacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccat

SEQ ID NO: 579863 - DNA, 486 bp, Homo sapiens; identical to SEQ ID NO: 535043
  misc_feature: HIJSMM301EIM7H.46.35.D02.1.454.light.4.raw

SEQ ID NO: 579864 - DNA, 444 bp, Homo sapiens; identical to SEQ ID NO: 536685
  misc_feature: HIJSMM301A26I9.10.76.G10.1.454.light.4.raw

SEQ ID NO: 579865 - DNA, 520 bp, Homo sapiens; identical to SEQ ID NO: 579367
  misc_feature: HIJSMM301C3JXW.27.23.C01.1.454.light.4.raw

SEQ ID NO: 579866 - DNA, 511 bp, Homo sapiens
  misc_feature: HIJSMM301A3BD6.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcggagggaccaaggctgaccgtctaacgtcagccacggactgccccctccggtcgactctcg

SEQ ID NO: 579867 - DNA, 517 bp, Homo sapiens; identical to SEQ ID NO: 547586
  misc_feature: HIJSMM301CKR5S.43.81.H04.1.454.light.4.raw

SEQ ID NO: 579868 - DNA, 486 bp, Homo sapiens
  misc_feature: HIJSMM301AG5TS.41.44.D11.1.454.light.4.raw
tctatactatcacgaccggtgctcgatttagcgcagtacgaaggggactgcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagccaa

SEQ ID NO: 579869 - DNA, 500 bp, Homo sapiens
  misc_feature: HIJSMM301D3F4T.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctcctgaccatctctgggctccaggctgatgacgaggctgattattactgcaggtcatatacaatcagcaacacttatgtcttcgggactgggaccaagatcaccgtcctaggtcagcccaaggccaacccactgtca

SEQ ID NO: 579870 - DNA, 504 bp, Homo sapiens
  misc_feature: HIJSMM301CBO1Y.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatccacgggacgcaacatgggatgacaatctgagcggttgggtgttcggcggagggaccaaactgaccgtcctaggtcagcccaa

SEQ ID NO: 579871 - DNA, 486 bp, Homo sapiens
  misc_feature: HIJSMM301BTB60.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagttttccctttaattcttcggccaagggacacgactggagattaaacgaactgtggctgcacc

SEQ ID NO: 579872 - DNA, 502 bp, Homo sapiens; identical to SEQ ID NO: 539002
  misc_feature: HIJSMM301C7780.18.59.F04.1.454.light.4.raw

SEQ ID NO: 579873 - DNA, 504 bp, Homo sapiens
  misc_feature: HIJSMM301AXG0Z.41.53.E09.1.454.light.4.raw
tctatactatcacgaccggtgctcgatttagagagagtgtgttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcagcccaaggctgccccctcggtcactctgttccca

SEQ ID NO: 579874 - DNA, 485 bp, Homo sapiens
  misc_feature: HIJSMM301DI4RS.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcacttcggcggagggaccaaggtggagatcaagcgaactgtggctgcaccat

SEQ ID NO: 579875 - DNA, 485 bp, Homo sapiens
  misc_feature: HIJSMM301CG1GV.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaaactgtggctgcaccat

SEQ ID NO: 579876 - DNA, 519 bp, Homo sapiens
  misc_feature: HIJSMM301DE0UV.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccgcct

SEQ ID NO: 579877 - DNA, 458 bp, Homo sapiens
  misc_feature: HIJSMM301A64XY.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctggtcactctgttcccacctcctcacgcgtatgt

SEQ ID NO: 579878 - DNA, 457 bp, Homo sapiens
  misc_feature: HIJSMM301AQ627.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcgggtccttaagggtccctaggaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 579879 - DNA, 496 bp, Homo sapiens
  misc_feature: HIJSMM301C77K1.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggtacacttttggccgggggtaccaagctggagatcaaacgaactgtggctgcaccatctgtcttcta

SEQ ID NO: 579880 - DNA, 488 bp, Homo sapiens
  misc_feature: HIJSMM301DRJCJ.41.11.A11.1.454.light.4.raw
tctatactatcacgaccggtgctcgatttagctacgactgcagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttggtactttggcgagggaccaagctggagatcagacgaactagtggctgcacatctgtcttcta

SEQ ID NO: 579881 - DNA, 476 bp, Homo sapiens; identical to SEQ ID NO: 549636
  misc_feature: HIJSMM301CT29K.41.5.A05.1.454.light.4.raw

SEQ ID NO: 579882 - DNA, 491 bp, Homo sapiens
  misc_feature: HIJSMM301DPH04.12.51.E07.1.454.light.4.raw
atacgacgtacacgaccggtgctcgatttagcatactctacaacacacaaagggggcaggagtcagacccagtcaggacacagcatggacatgaagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcaccta

SEQ ID NO: 579883 - DNA, 478 bp, Homo sapiens; identical to SEQ ID NO: 535129
  misc_feature: HIJSMM301BOJ4I.11.11.A11.1.454.light.4.raw

SEQ ID NO: 579884 - DNA, 503 bp, Homo sapiens
  misc_feature: HIJSMM301DV763.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaaccgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtcttggt

SEQ ID NO: 579885 - DNA, 494 bp, Homo sapiens
  misc_feature: HIJSMM301ESW77.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctggtcagcccaaggctgccccctcggtcactc

SEQ ID NO: 579886 - DNA, 487 bp, Homo sapiens
  misc_feature: HIJSMM301BFJ7S.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggatatcagacgaa

SEQ ID NO: 579887 - DNA, 492 bp, Homo sapiens
  misc_feature: HIJSMM301D8V20.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggcaagggcacgactggaaataaacgaactgtggctgcaccatctgtcttcatcttcccgcc

SEQ ID NO: 579888 - DNA, 506 bp, Homo sapiens
  misc_feature: HIJSMM301CNRHL.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggacccaaacgtgaccgtcctagggtcagccccaa

SEQ ID NO: 579889 - DNA, 477 bp, Homo sapiens
  misc_feature: HIJSMM301CJRRC.10.74.G08.1.454.light.4.raw
catagtagtgcacgaccggtgctcgatttagtagctctatcagggagaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggaccagggtggaaatcaaacgaactgtggctgcacc

SEQ ID NO: 579890 - DNA, 516 bp, Homo sapiens
  misc_feature: HIJSMM301C381Y.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgacggaccgaaggtaggaagtacaacgaactagtggctgcaccactctgtcttctatcttcccgtccactctcgat

SEQ ID NO: 579891 - DNA, 513 bp, Homo sapiens
  misc_feature: HIJSMM301B01CR.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagcccaaggc

SEQ ID NO: 579892 - DNA, 522 bp, Homo sapiens
  misc_feature: HIJSMM301C0WDK.41.19.B08.1.454.light.4.raw
tctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactcgtcactctgttcccgccctcctcta

SEQ ID NO: 579893 - DNA, 482 bp, Homo sapiens
  misc_feature: HIJSMM301B030C.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtgggtcccatcaaggttcagcggcagtggatctgggacagaattcactctcaccatcagcagcctacagcctgatgattttgcgacttattattgccaacagtataagagttattcaactttcggccctgggaccaatgtggatatacaaacgaactgtggctgcaccatctgtt

SEQ ID NO: 579894 - DNA, 509 bp, Homo sapiens; identical to SEQ ID NO: 553073
  misc_feature: HIJSMM301EVOSX.16.1.A01.1.454.light.4.raw

SEQ ID NO: 579895 - DNA, 473 bp, Homo sapiens; identical to SEQ ID NO: 535262
  misc_feature: HIJSMM301AJWDR.8.67.G01.1.454.light.4.raw

SEQ ID NO: 579896 - DNA, 507 bp, Homo sapiens; identical to SEQ ID NO: 535930
  misc_feature: HIJSMM301AHSSA.15.34.D01.1.454.light.4.raw

SEQ ID NO: 579897 - DNA, 446 bp, Homo sapiens
  misc_feature: HIJSMM301EELOD.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagatacactacctcgacggtcgtccgacgacgacga

SEQ ID NO: 579898 - DNA, 478 bp, Homo sapiens
  misc_feature: HIJSMM301BTLO7.48.55.E11.1.454.light.4.raw
agtatacatacacgaccggtgctcgatttagcactcgcacgttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttcggcggagggaccaagctgaccgtcctaagtcagacccg

SEQ ID NO: 579899 - DNA, 480 bp, Homo sapiens; identical to SEQ ID NO: 535442
  misc_feature: HIJSMM301DWC8J.41.17.B06.1.454.light.4.raw

SEQ ID NO: 579900 - DNA, 485 bp, Homo sapiens
  misc_feature: HIJSMM301AMQVF.43.76.G10.1.454.light.4.raw
tgtgagtagtcacgaccggtgctcgatttagtcactcatacaggggactggcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcagtggcatcaatgttgctacccacacaatatactggtaccagcagaagtcagggagtcctccccagtttctcctgaggtacaaatcagactcagataagcagcagggctctggaatccccagccgcttctctggatccaaggatgcttcggccaatgcaggaattttgctcatctctgggctccagtctgaggatgaggctgactattactgtacgatttggtacaacgacgctgtggttttcggcggagggaccgaagctgaccgtcctaagtcacg

SEQ ID NO: 579901 - DNA, 478 bp, Homo sapiens; identical to SEQ ID NO: 535129
  misc_feature: HIJSMM301EHREG.11.11.A11.1.454.light.4.raw

SEQ ID NO: 579902 - DNA, 489 bp, Homo sapiens; identical to SEQ ID NO: 553074
  misc_feature: HIJSMM301EOK8S.14.33.C11.1.454.light.4.raw

SEQ ID NO: 579903 - DNA, 454 bp, Homo sapiens; identical to SEQ ID NO: 534964
  misc_feature: HIJSMM301CUP2C.19.86.H09.1.454.light.4.raw

SEQ ID NO: 579904 - DNA, 494 bp, Homo sapiens
  misc_feature: HIJSMM301BDN68.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatcttcccgccatcg

SEQ ID NO: 579905 - DNA, 471 bp, Homo sapiens; identical to SEQ ID NO: 537461
  misc_feature: HIJSMM301C05XE.7.81.H04.1.454.light.4.raw

SEQ ID NO: 579906 - DNA, 466 bp, Homo sapiens
  misc_feature: HIJSMM301EA3X9.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaatggggtcccatcaaggttcagtggcagtggatctgggacagattcactctaaccatcagcgtctgcaacctgaagattttgcaactcactactgtcaacagagtgacagcacgcctcacactttcggcggacgggaccaagggtggagatacaaacgaa

SEQ ID NO: 579907 - DNA, 467 bp, Homo sapiens
  misc_feature: HIJSMM301C3NT4.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagatacc

SEQ ID NO: 579908 - DNA, 494 bp, Homo sapiens; identical to SEQ ID NO: 534992
  misc_feature: HIJSMM301ED5Q2.9.1.A01.1.454.light.4.raw

SEQ ID NO: 579909 - DNA, 489 bp, Homo sapiens; identical to SEQ ID NO: 536013
  misc_feature: HIJSMM301AKIN0.26.23.C01.1.454.light.4.raw

SEQ ID NO: 579910 - DNA, 483 bp, Homo sapiens; identical to SEQ ID NO: 575196
  misc_feature: HIJSMM301CXWIQ.41.34.D01.1.454.light.4.raw

SEQ ID NO: 579911 - DNA, 486 bp, Homo sapiens; identical to SEQ ID NO: 535290
  misc_feature: HIJSMM301EZ2YY.3.12.B01.1.454.light.4.raw

SEQ ID NO: 579912 - DNA, 501 bp, Homo sapiens; identical to SEQ ID NO: 569143
  misc_feature: HIJSMM301BJ58P.18.59.F04.1.454.light.4.raw

SEQ ID NO: 579913 - DNA, 496 bp, Homo sapiens; identical to SEQ ID NO: 535109
  misc_feature: HIJSMM301CPEYW.16.78.H01.1.454.light.4.raw

SEQ ID NO: 579914 - DNA, 481 bp, Homo sapiens; identical to SEQ ID NO: 535993
  misc_feature: HIJSMM301CPHML.21.25.C03.1.454.light.4.raw

SEQ ID NO: 579915 - DNA, 495 bp, Homo sapiens; identical to SEQ ID NO: 548564
  misc_feature: HIJSMM301BRXMJ.9.1.A01.1.454.light.4.raw

SEQ ID NO: 579916 - DNA, 502 bp, Homo sapiens
  misc_feature: HIJSMM301AULVX.40.42.D09.1.454.light.4.raw
tctagcgactcacgaccggtgctcgatttagacacatacgcagggaaagggggtgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgaccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtctaggtcagcccaaggctcgccccctcggtcactc

SEQ ID NO: 579917 - DNA, 500 bp, Homo sapiens
  misc_feature: HIJSMM301AJRA7.15.1.A01.1.454.light.4.raw
  modified_base (469)..(469): a, c, t, g, unknown or other
  modified_base (492)..(492): a, c, t, g, unknown or other
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcngcgtcagcccaaggctgcccccncggtcact

SEQ ID NO: 579918 - DNA, 476 bp, Homo sapiens; identical to SEQ ID NO: 537368
  misc_feature: HIJSMM301A3P02.7.83.H06.1.454.light.4.raw

SEQ ID NO: 579919 - DNA, 489 bp, Homo sapiens; identical to SEQ ID NO: 538992
  misc_feature: HIJSMM301EW4MQ.21.65.F10.1.454.light.4.raw

SEQ ID NO: 579920 - DNA, 491 bp, Homo sapiens; identical to SEQ ID NO: 535194
  misc_feature: HIJSMM301C0D6K.26.78.H01.1.454.light.4.raw

SEQ ID NO: 579921 - DNA, 487 bp, Homo sapiens
  misc_feature: HIJSMM301DH5ZE.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggcgagggaccaaggtggagatcaagcgaactgtggctgcaccat

SEQ ID NO: 579922 - DNA, 502 bp, Homo sapiens
  misc_feature: HIJSMM301AMBH1.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggaaatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggtcggagggaccaaggtggagatcaaacgaactgtggctgcaccatctgtcttcatcttcccgccat

SEQ ID NO: 579923 - DNA, 491 bp, Homo sapiens
  misc_feature: HIJSMM301AWF99.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatccaccttcggccaagggacacgactggagattaacgaactgtggctgcaccatctgtcttcat

SEQ ID NO: 579924 - DNA, 512 bp, Homo sapiens
  misc_feature: HIJSMM301BBEDQ.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcctcctcgctacg

SEQ ID NO: 579925 - DNA, 518 bp, Homo sapiens
  misc_feature: HIJSMM301EGFT9.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgttccccg

SEQ ID NO: 579926 - DNA, 495 bp, Homo sapiens
  misc_feature: HIJSMM301DRE5U.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgtactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgt

SEQ ID NO: 579927 - DNA, 486 bp, Homo sapiens; identical to SEQ ID NO: 535385
  misc_feature: HIJSMM301A29UQ.19.71.G05.1.454.light.4.raw

SEQ ID NO: 579928 - DNA, 479 bp, Homo sapiens; identical to SEQ ID NO: 537186
  misc_feature: HIJSMM301BLPUZ.22.59.F04.1.454.light.4.raw

SEQ ID NO: 579929 - DNA, 499 bp, Homo sapiens
  misc_feature: HIJSMM301B5SFG.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattaactgtcaacagtaatcataatctccccactttcggtcccctgggtacccaaaagtggagtaattcaaacgaaacctgtggctgcaccatcctgtt

SEQ ID NO: 579930 - DNA, 453 bp, Homo sapiens; identical to SEQ ID NO: 544521
  misc_feature: HIJSMM301CYZC2.19.86.H09.1.454.light.4.raw

SEQ ID NO: 579931 - DNA, 507 bp, Homo sapiens
  misc_feature: HIJSMM301DN8YN.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 579932 - DNA, 494 bp, Homo sapiens
  misc_feature: HIJSMM301C14T4.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtaggatttctagacgaactgtggctgcaccatctgtcttcta

SEQ ID NO: 579933 - DNA, 455 bp, Homo sapiens
  misc_feature: HIJSMM301CMJ8C.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcgggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctcccacgagagta

SEQ ID NO: 579934 - DNA, 484 bp, Homo sapiens
  misc_feature: HIJSMM301CEOFI.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccaactctacgtcgtagcgggcggtcggcgacggacggcgactaagtg

SEQ ID NO: 579935 - DNA, 495 bp, Homo sapiens; identical to SEQ ID NO: 550081
  misc_feature: HIJSMM301C9PMF.43.39.D06.1.454.light.4.raw

SEQ ID NO: 579936 - DNA, 488 bp, Homo sapiens
  misc_feature: HIJSMM301DMYM1.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaaggaaacacagcctccctgaccattactggactccagcctgaggacgaggctgactatactgctcagcatgggacagcggcctcaggacttatgtcttcggaactgggacccacgttaccgtcctaggtcagaccccg

SEQ ID NO: 579937 - DNA, 484 bp, Homo sapiens; identical to SEQ ID NO: 540581
  misc_feature: HIJSMM301AKV27.3.88.H11.1.454.light.4.raw

SEQ ID NO: 579938 - DNA, 462 bp, Homo sapiens
  misc_feature: HIJSMM301EOSHB.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagtccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggcctgggaccagagtggacatgaaacgaa

SEQ ID NO: 579939 - DNA, 479 bp, Homo sapiens; identical to SEQ ID NO: 537141
  misc_feature: HIJSMM301DGZ9S.7.76.G10.1.454.light.4.raw

SEQ ID NO: 579940 - DNA, 500 bp, Homo sapiens
  misc_feature: HIJSMM301BN6HU.48.33.C11.1.454.light.4.raw
agtatacatacacgaccggtgctcgatttagagtgagctcgttgggtttgggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcacca

SEQ ID NO: 579941 - DNA, 454 bp, Homo sapiens; identical to SEQ ID NO: 534964
  misc_feature: HIJSMM301C5LT5.19.86.H09.1.454.light.4.raw

SEQ ID NO: 579942 - DNA, 508 bp, Homo sapiens
  misc_feature: HIJSMM301B70VU.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctccgctacgtaga

SEQ ID NO: 579943 - DNA, 500 bp, Homo sapiens
  misc_feature: HIJSMM301DO72V.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccact

SEQ ID NO: 579944 - DNA, 496 bp, Homo sapiens; identical to SEQ ID NO: 535109
  misc_feature: HIJSMM301CUVMZ.16.78.H01.1.454.light.4.raw

SEQ ID NO: 579945 - DNA, 484 bp, Homo sapiens; identical to SEQ ID NO: 535400
  misc_feature: HIJSMM301AYMOP.46.26.C04.1.454.light.4.raw

SEQ ID NO: 579946 - DNA, 511 bp, Homo sapiens
  misc_feature: HIJSMM301AVJ3G.40.78.H01.1.454.light.4.raw
tctagcgactcacgaccggtgctcgatttagtgtgagtagtttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtccta

SEQ ID NO: 579947 - DNA, 489 bp, Homo sapiens; identical to SEQ ID NO: 543840
  misc_feature: HIJSMM301AMMQX.12.88.H11.1.454.light.4.raw

SEQ ID NO: 579948 - DNA, 473 bp, Homo sapiens; identical to SEQ ID NO: 535262
  misc_feature: HIJSMM301CB525.8.67.G01.1.454.light.4.raw

SEQ ID NO: 579949 - DNA, 491 bp, Homo sapiens
  misc_feature: HIJSMM301CPXK3.14.55.E11.1.454.light.4.raw
  modified_base (432)..(432): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacgatcccagatgacccagtcgtccatcctcccgtgtcctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggagggaccaaggcggagatcagcgaactgtggctgcaccatctgtcttc

SEQ ID NO: 579950 - DNA, 444 bp, Homo sapiens; identical to SEQ ID NO: 535192
  misc_feature: HIJSMM301ARJFI.5.9.A09.1.454.light.4.raw

SEQ ID NO: 579951 - DNA, 480 bp, Homo sapiens; identical to SEQ ID NO: 535291
  misc_feature: HIJSMM301AX2BN.22.59.F04.1.454.light.4.raw

SEQ ID NO: 579952 - DNA, 514 bp, Homo sapiens; identical to SEQ ID NO: 546238
  misc_feature: HIJSMM301DRT86.47.85.H08.1.454.light.4.raw

SEQ ID NO: 579953 - DNA, 500 bp, Homo sapiens
  misc_feature: HIJSMM301C5OYH.41.11.A11.1.454.light.4.raw
tctatactatcacgaccggtgctcgatttagctacgactgcaggggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactgggccttcgggtaacttttggtccgacggggaccgaagactggagatcagacgaactgtggctgcaccatctgtcttcta

SEQ ID NO: 579954 - DNA, 495 bp, Homo sapiens; identical to SEQ ID NO: 543016
  misc_feature: HIJSMM301CIEZ1.3.31.C09.1.454.light.4.raw

SEQ ID NO: 579955 - DNA, 490 bp, Homo sapiens
  misc_feature: HIJSMM301B7G6X.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtatttgcaacttactactgtacaacagagttacacgtacccccctcactttcggcggagggaccgaggcggagatcagacgaactgtgctgcaccatctgtcttcta

SEQ ID NO: 579956 - DNA, 504 bp, Homo sapiens
  misc_feature: HIJSMM301EM900.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttaagggcagttttcactctcacaatcagcagtctcgaacctgaagatttgcaacttactactgtcaacagacttacaatataccgaggacgttcggtcaagggaccaaggtggagatcaaacgaactagtggctgcaccatctgtcttcatcttccgcat

SEQ ID NO: 579957 - DNA, 501 bp, Homo sapiens; identical to SEQ ID NO: 537459
  misc_feature: HIJSMM301A09MP.18.26.C04.1.454.light.4.raw

SEQ ID NO: 579958 - DNA, 499 bp, Homo sapiens
  misc_feature: HIJSMM301DIVH7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtgtcgacggaccaacggtaggaatacaaacgaaacctagtgcgtgcacatctgtcttctatctt

SEQ ID NO: 579959 - DNA, 447 bp, Homo sapiens; identical to SEQ ID NO: 535020
  misc_feature: HIJSMM301BQC0K.18.9.A09.1.454.light.4.raw

SEQ ID NO: 579960 - DNA, 496 bp, Homo sapiens
  misc_feature: HIJSMM301EVT5I.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaaatatgcttaattggtaccaacaaaaagccaaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacgttatctttaatgtcttcggatctgggaccagggtcaccgtcctagtcagcccaaggccaaccccactcg

SEQ ID NO: 579961 - DNA, 497 bp, Homo sapiens; identical to SEQ ID NO: 536371
  misc_feature: HIJSMM301BEYOZ.16.78.H01.1.454.light.4.raw

SEQ ID NO: 579962 - DNA, 486 bp, Homo sapiens; identical to SEQ ID NO: 535917
  misc_feature: HIJSMM301BH6R3.3.10.A10.1.454.light.4.raw

SEQ ID NO: 579963 - DNA, 474 bp, Homo sapiens
  misc_feature: HIJSMM301CCEOG.40.52.E08.1.454.light.4.raw
tctagcgactcacgaccggtgctcgatttagtcgagctctcagagagaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaactagcagtgacattggtgcttataactatgtctcctggtaccaacaacacccaggcgaggcccccaaactcatgatttatgatgtcaataatcggccctcaggggtttctaatcgcttctctggctccaagtctggcaacacggcctccctgaccatctctgggctccaagctgaggacgaggctgtttatttctgcagctcatatacaagcagcaacactctggtgttcggcggagggaccaagctgaccgt

SEQ ID NO: 579964 - DNA, 495 bp, Homo sapiens; identical to SEQ ID NO: 550605
  misc_feature: HIJSMM301A8LG9.41.38.D05.1.454.light.4.raw

SEQ ID NO: 579965 - DNA, 486 bp, Homo sapiens; identical to SEQ ID NO: 537127
  misc_feature: HIJSMM301EAWWD.3.77.G11.1.454.light.4.raw

SEQ ID NO: 579966 - DNA, 497 bp, Homo sapiens
  misc_feature: HIJSMM301B4IAQ.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagcccactctgaccatcagcgggacccaggctctcgatgaggctgactattactgccaggcgtgggacagctccacttcccgttatgtcttcggaggtgggaccatggtcaccgtctaggtcagcccaagacccaacccactgt

SEQ ID NO: 579967 - DNA, 505 bp, Homo sapiens
  misc_feature: HIJSMM301DGV0K.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtccctgaccgattcagaggcagcgggtctgggacagatttcactctcaccatccaccaacctgcaggctgaagatgtggcagtttattactgtcagcaatactatagtcctcctctcacgttcggcggagggaccaagggtggagatacaaacgaactgtggctgcaccatctgtctt

SEQ ID NO: 579968 - DNA, 500 bp, Homo sapiens; identical to SEQ ID NO: 543863
  misc_feature: HIJSMM301A0A0B.12.26.C04.1.454.light.4.raw

SEQ ID NO: 579969 - DNA, 485 bp, Homo sapiens
  misc_feature: HIJSMM301BKE7N.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggcctgggaccaaagtggatatcaaacgaactgtggctgcaccatctgtt

SEQ ID NO: 579970 - DNA, 521 bp, Homo sapiens; identical to SEQ ID NO: 539470
  misc_feature: HIJSMM301C5CDA.27.23.C01.1.454.light.4.raw

SEQ ID NO: 579971 - DNA, 520 bp, Homo sapiens; identical to SEQ ID NO: 539176
  misc_feature: HIJSMM301DA3HB.27.23.C01.1.454.light.4.raw

SEQ ID NO: 579972 - DNA, 483 bp, Homo sapiens
  misc_feature: HIJSMM301EW2GM.4.41.D08.1.454.light.4.raw
  modified_base (169)..(169): a, c, t, g, unknown or other
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctcctnttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactagtggctgcaccat

SEQ ID NO: 579973 - DNA, 486 bp, Homo sapiens; identical to SEQ ID NO: 556759
  misc_feature: HIJSMM301DAGTR.15.1.A01.1.454.light.4.raw

SEQ ID NO: 579974 - DNA, 492 bp, Homo sapiens; identical to SEQ ID NO: 534967
  misc_feature: HIJSMM301ERGLX.47.64.F09.1.454.light.4.raw

SEQ ID NO: 579975 - DNA, 509 bp, Homo sapiens; identical to SEQ ID NO: 541168
  misc_feature: HIJSMM301DDOZ0.5.60.F05.1.454.light.4.raw

SEQ ID NO: 579976 - DNA, 485 bp, Homo sapiens; identical to SEQ ID NO: 573100
  misc_feature: HIJSMM301BTB2I.49.35.D02.1.454.light.4.raw

SEQ ID NO: 579977 - DNA, 495 bp, Homo sapiens; identical to SEQ ID NO: 535596
  misc_feature: HIJSMM301AJWFA.10.79.H02.1.454.light.4.raw

SEQ ID NO: 579978 - DNA, 471 bp, Homo sapiens; identical to SEQ ID NO: 565736
  misc_feature: HIJSMM301CNWSJ.5.70.G04.1.454.light.4.raw

SEQ ID NO: 579979 - DNA, 478 bp, Homo sapiens; identical to SEQ ID NO: 538887
  misc_feature: HIJSMM301CJ925.7.67.G01.1.454.light.4.raw

SEQ ID NO: 579980 - DNA, 496 bp, Homo sapiens
  misc_feature: HIJSMM301BX8D6.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggtttcggtcggagggaccaagctgaccgtcctaggtcagccaaggctgccccctcggt

SEQ ID NO: 579981 - DNA, 405 bp, Homo sapiens
  misc_feature: HIJSMM301C5H0E.49.68.G02.1.454.light.4.raw
agtcgagagacacgaccggtgctcgatttagtcgatagtgaagggaaagggggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtctaggtcagcccaaggccaaccccactgtcactctgttcccaccctcctctctctcgact

SEQ ID NO: 579982 - DNA, 486 bp, Homo sapiens
  misc_feature: HIJSMM301A55QK.15.1.A01.1.454.light.4.raw
  modified_base (485)..(485): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagccctaaggcctcgcccctcggtcactctgttcccgcctcctcgctacgtana

SEQ ID NO: 579983 - DNA, 488 bp, Homo sapiens; identical to SEQ ID NO: 545753
  misc_feature: HIJSMM301CT9DJ.46.26.C04.1.454.light.4.raw

SEQ ID NO: 579984 - DNA, 473 bp, Homo sapiens
  misc_feature: HIJSMM301EZ66D.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatcagagacacgcgag

SEQ ID NO: 579985 - DNA, 498 bp, Homo sapiens; identical to SEQ ID NO: 536977
  misc_feature: HIJSMM301B117P.11.75.G09.1.454.light.4.raw

SEQ ID NO: 579986 - DNA, 507 bp, Homo sapiens; identical to SEQ ID NO: 535641
  misc_feature: HIJSMM301A3XV6.10.88.H11.1.454.light.4.raw

SEQ ID NO: 579987 - DNA, 491 bp, Homo sapiens; identical to SEQ ID NO: 536211
  misc_feature: HIJSMM301CYNK6.16.53.E09.1.454.light.4.raw

SEQ ID NO: 579988 - DNA, 515 bp, Homo sapiens
  misc_feature: HIJSMM301ESJU9.9.20.B09.1.454.light.4.raw
tgatacgtctcacgaccggtgctcgatttagtgtagtgtgaaggggctgggcctaaggaagcagcactggtggtgcctcagccattgcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccaagctgaccgtcctaggtcagcccaaggctgccccctcggtcactctcgttcccaccctcctcagacgtatca

SEQ ID NO: 579989 - DNA, 507 bp, Homo sapiens; identical to SEQ ID NO: 557429
  misc_feature: HIJSMM301BN6WA.15.59.F04.1.454.light.4.raw

SEQ ID NO: 579990 - DNA, 474 bp, Homo sapiens
  misc_feature: HIJSMM301D10T4.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaagcccctaaactcctgatctctgctgccgccagtttgcaaagtgggtcccatcaagattcagtggcagtggatctgggacagatttcactctcgccatcagtagtctgcaacctgatgattttgcaacttactactgtacaacagagttccactaccccaatcactttcggcctgggactgaagtgcatatgaagagaactgtggctgca

SEQ ID NO: 579991 - DNA, 513 bp, Homo sapiens
  misc_feature: HIJSMM301C73KR.41.9.A09.1.454.light.4.raw
tctatactatcacgaccggtgctcgatttagcgagacgcgcaggggcagcttcagctgtgggtagagaagacaggactcaggacaatcctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactc

SEQ ID NO: 579992 - DNA, 498 bp, Homo sapiens; identical to SEQ ID NO: 535974
  misc_feature: HIJSMM301ELQAT.22.27.C05.1.454.light.4.raw

SEQ ID NO: 579993 - DNA, 494 bp, Homo sapiens
  misc_feature: HIJSMM301A61EY.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacggaccgaaacgtaggacatcaagcgaactagtggctgcaccatctgt

SEQ ID NO: 579994 - DNA, 499 bp, Homo sapiens
  misc_feature: HIJSMM301AWJY8.48.67.G01.1.454.light.4.raw
agtatacatacacgaccggtgctcgatttagagtatacatattgggtttggggactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaacgaactgtggctgcaccatctgtcttcatcttcccg

SEQ ID NO: 579995 - DNA, 496 bp, Homo sapiens; identical to SEQ ID NO: 535541
  misc_feature: HIJSMM301DPN2X.3.33.C11.1.454.light.4.raw

SEQ ID NO: 579996 - DNA, 504 bp, Homo sapiens; identical to SEQ ID NO: 561260
  misc_feature: HIJSMM301CHHZF.18.78.H01.1.454.light.4.raw

SEQ ID NO: 579997 - DNA, 486 bp, Homo sapiens; identical to SEQ ID NO: 563598
  misc_feature: HIJSMM301D3YCK.14.53.E09.1.454.light.4.raw

SEQ ID NO: 579998 - DNA, 484 bp, Homo sapiens; identical to SEQ ID NO: 535211
  misc_feature: HIJSMM301CAFAK.47.46.E02.1.454.light.4.raw

SEQ ID NO: 579999 - DNA, 487 bp, Homo sapiens; identical to SEQ ID NO: 536206
  misc_feature: HIJSMM301B3ZFL.47.38.D05.1.454.light.4.raw

SEQ ID NO: 580000 - DNA, 510 bp, Homo sapiens; identical to SEQ ID NO: 535855
  misc_feature: HIJSMM301DONE1.17.33.C11.1.454.light.4.raw

SEQ ID NO: 580001 - DNA, 486 bp, Homo sapiens
  misc_feature: HIJSMM301D4CTP.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagacgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtgg

SEQ ID NO: 580002 - DNA, 497 bp, Homo sapiens
  misc_feature: HIJSMM301D74FN.40.4.A04.1.454.light.4.raw
tctagcgactcacgaccggtgctcgatttagagtagtgatcagggggagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttactctcaccatcaccagccttcaggctgaagatgtggcagttattatgtcaccaatattatacattctccgacgtcgtcacggaccgaagaggaggagtacaacgaaactaacgtaggtcgtgcacacta

SEQ ID NO: 580003 - DNA, 513 bp, Homo sapiens
  misc_feature: HIJSMM301AZBM9.43.27.C05.1.454.light.4.raw
tgtgagtagtcacgaccggtgctcgatttagacgcgatcgaagggtttggggggccgtttgcattgtgaactgagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtcggaaatcaaacgaactagtgg

SEQ ID NO: 580004 - DNA, 464 bp, Homo sapiens; identical to SEQ ID NO: 536640
  misc_feature: HIJSMM301DJMRO.26.78.H01.1.454.light.4.raw

SEQ ID NO: 580005 - DNA, 504 bp, Homo sapiens
  misc_feature: HIJSMM301CTO9P.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaattatttttctatcctccgtggacgttcggccaagggaccagggtggaaatcagacgaactgtggctgcaccat

SEQ ID NO: 580006 - DNA, 495 bp, Homo sapiens; identical to SEQ ID NO: 538269
  misc_feature: HIJSMM301EG28F.9.1.A01.1.454.light.4.raw

SEQ ID NO: 580007 - DNA, 484 bp, Homo sapiens
  misc_feature: HIJSMM301CDT5U.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgccaagctctacaatcccgctcactttcggcggagggaccaaggtggagatcaaacgaa

SEQ ID NO: 580008 - DNA, 485 bp, Homo sapiens; identical to SEQ ID NO: 535501
  misc_feature: HIJSMM301B7YD5.3.10.A10.1.454.light.4.raw

SEQ ID NO: 580009 - DNA, 493 bp, Homo sapiens; identical to SEQ ID NO: 571339
  misc_feature: HIJSMM301BTIWX.10.72.G06.1.454.light.4.raw

SEQ ID NO: 580010 - DNA, 500 bp, Homo sapiens
  misc_feature: HIJSMM301DOK3X.41.49.E05.1.454.light.4.raw
tctatactatcacgaccggtgctcgatttagagcgactagcaacacacaaagggggaggaactgctcagttaggacccagagggaaccatggaagccccagctcagcttctcttcctcctgctactctggctcccagataccaccggagaaattgtgttgacacagtctccagccaccctgtctctgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagaacctgaagattttgcaatttattactgtcagcagcgtatcaactggcctccgtggacgttcggccaaggaccaacggtaggaaatacaaacgaactagtggctgcaccactctgtt

SEQ ID NO: 580011 - DNA, 490 bp, Homo sapiens; identical to SEQ ID NO: 575557
  misc_feature: HIJSMM301C6K45.3.55.E11.1.454.light.4.raw

SEQ ID NO: 580012 - DNA, 495 bp, Homo sapiens; identical to SEQ ID NO: 539489
  misc_feature: HIJSMM301B0CLD.51.59.F04.1.454.light.4.raw

SEQ ID NO: 580013 - DNA, 486 bp, Homo sapiens; identical to SEQ ID NO: 535385
  misc_feature: HIJSMM301DW7EE.19.71.G05.1.454.light.4.raw

SEQ ID NO: 580014 - DNA, 491 bp, Homo sapiens
  misc_feature: HIJSMM301B48X5.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatatagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattccttttactttcggccctgggaccaaagtggatatcaaacgaactgtggctgcaccat

SEQ ID NO: 580015 - DNA, 501 bp, Homo sapiens; identical to SEQ ID NO: 550407
  misc_feature: HIJSMM301BI8SB.4.39.D06.1.454.light.4.raw

SEQ ID NO: 580016 - DNA, 494 bp, Homo sapiens; identical to SEQ ID NO: 534994
  misc_feature: HIJSMM301CDCFX.27.78.H01.1.454.light.4.raw

SEQ ID NO: 580017 - DNA, 480 bp, Homo sapiens
  misc_feature: HIJSMM301AT6XG.51.34.D01.1.454.light.4.raw
cgatcgtatacacgaccggtgctcgatttagatcgtctgtgttgggtttggggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacaggccgttgcgctcactttcggcgggggaccgaaggtggagatcaagcgaactgtggctgcaccatctgtt

SEQ ID NO: 580018 - DNA, 500 bp, Homo sapiens
  misc_feature: HIJSMM301DUKPS.40.37.D04.1.454.light.4.raw
tctagcgactcacgaccggtgctcgatttagtagcatactgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgcttgctcttatgcaggcagtttcgctctcgaagtgttcggcggagggaccgagctgaccgtcctacgtcagcccaaggctccg

SEQ ID NO: 580019 - DNA, 489 bp, Homo sapiens; identical to SEQ ID NO: 535139
  misc_feature: HIJSMM301CX17L.14.55.E11.1.454.light.4.raw

SEQ ID NO: 580020 - DNA, 505 bp, Homo sapiens; identical to SEQ ID NO: 536254
  misc_feature: HIJSMM301COVQC.7.71.G05.1.454.light.4.raw

SEQ ID NO: 580021 - DNA, 497 bp, Homo sapiens
  misc_feature: HIJSMM301EQ3ZO.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagattttaatttcaccatcagcagcctccaacgtgatgatgttgcaacatactattgtcagcaatatgattttgctcctccgagtgcctacttttggcgggggaccaaggtggacatcaaacgaactgtggctgcaccatctgtcttcat

SEQ ID NO: 580022 - DNA, 509 bp, Homo sapiens; identical to SEQ ID NO: 541829
  misc_feature: HIJSMM301BLAJK.17.28.C06.1.454.light.4.raw

SEQ ID NO: 580023 - DNA, 447 bp, Homo sapiens; identical to SEQ ID NO: 535020
  misc_feature: HIJSMM301EMPZT.18.9.A09.1.454.light.4.raw

SEQ ID NO: 580024 - DNA, 507 bp, Homo sapiens; identical to SEQ ID NO: 563344
  misc_feature: HIJSMM301CXNEB.3.79.H02.1.454.light.4.raw

SEQ ID NO: 580025 - DNA, 492 bp, Homo sapiens; identical to SEQ ID NO: 568542
  misc_feature: HIJSMM301D24X0.10.17.B06.1.454.light.4.raw

SEQ ID NO: 580026 - DNA, 492 bp, Homo sapiens; identical to SEQ ID NO: 541945
  misc_feature: HIJSMM301BU28X.49.67.G01.1.454.light.4.raw

SEQ ID NO: 580027 - DNA, 501 bp, Homo sapiens
  misc_feature: HIJSMM301C4LE8.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggct

SEQ ID NO: 580028 - DNA, 494 bp, Homo sapiens
  misc_feature: HIJSMM301BY5EZ.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgctacacttgggtgttcggcggagggaccaaggctgaccgtcctaggtcagcccaaggctgccccctcggtcactctgttcccgccctcctcacgcg

SEQ ID NO: 580029 - DNA, 510 bp, Homo sapiens
  misc_feature: HIJSMM301CDJGX.3.37.D04.1.454.light.4.raw
agacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcgaggggtttctaatcgcttctctggctccaagtctggcaacacggcctccctgaccatctctgggctccgagggtgaggacgaggctgattattactgcagctcatttacaagcagcaccactcaggtcttcggaactgggactaaggtcaccgtcctaggtcagcccaaggcccaacccactgtcactt

SEQ ID NO: 580030 - DNA, 489 bp, Homo sapiens; identical to SEQ ID NO: 535139
  misc_feature: HIJSMM301AUTPG.14.55.E11.1.454.light.4.raw

SEQ ID NO: 580031 - DNA, 502 bp, Homo sapiens
  misc_feature: HIJSMM301BRPWX.9.12.B01.1.454.light.4.raw
tgatacgtctcacgaccggtgctcgatttagtagtgtagattccgcggggacaacaggcaggcaggggcagcaagatggtgttgcagacccgggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaacggtggaaatcaaacgaactgtggctgcaccatctgtcttcatcttcccg

SEQ ID NO: 580032 - DNA, 481 bp, Homo sapiens
  misc_feature: HIJSMM301ANJLJ.5.52.E08.1.454.light.4.raw
atcagacacgcacgaccggtgctcgatttagtcgagctctcagagagaaaggggctgatcaggactcctcagttcaccttctcacaatgaggctccctgctcagctcctggggctgctaatgctctgggtctctggatccagtggggagattgtgctgactcagtctccactctccctgcccgtcacccctggagagccggcctccatctcctgcaggtctagtcagagcctcctgcatagtaatggattcaactatttggattggtacctgcagaggccagggcaggtctccacagctcctgatctatttgggctcttatcgggcctccggggtccctgagaggttcagtggcagtggatcaggcacagactttacactgagaatcagcagagtggaggctgaggatgttggggtttattacttggcatgcaagctctacaaaccctattcactttcggcctgggaccacgagtggatac

SEQ ID NO: 580033 - DNA, 496 bp, Homo sapiens; identical to SEQ ID NO: 535541
  misc_feature: HIJSMM301B7EGE.3.33.C11.1.454.light.4.raw

SEQ ID NO: 580034 - DNA, 496 bp, Homo sapiens; identical to SEQ ID NO: 535541
  misc_feature: HIJSMM301BB7CD.3.33.C11.1.454.light.4.raw

SEQ ID NO: 580035 - DNA, 485 bp, Homo sapiens; identical to SEQ ID NO: 543180
  misc_feature: HIJSMM301B9YS3.3.10.A10.1.454.light.4.raw

SEQ ID NO: 580036 - DNA, 520 bp, Homo sapiens
  misc_feature: HIJSMM301EPO7N.43.81.H04.1.454.light.4.raw
tgtgagtagtcacgaccggtgctcgatttagtagtgtagattcgcgggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcgttcggcgggggacgtcagttgaccgtcctaggtcagcccaaggctgccccctcggtcactctcttcccgccctccctcactactca

SEQ ID NO: 580037 - DNA, 508 bp, Homo sapiens
  misc_feature: HIJSMM301C6OSG.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctgactattactgcctactctactttggtggtgctgtgctattcggcggagggaccaagctgaccgtcttaagtcagccccaaggctgccccctcggtcactctgttcccg

SEQ ID NO: 580038 - DNA, 521 bp, Homo sapiens; identical to SEQ ID NO: 538715
  misc_feature: HIJSMM301BFTXB.27.23.C01.1.454.light.4.raw

SEQ ID NO: 580039 - DNA, 520 bp, Homo sapiens; identical to SEQ ID NO: 546218
  misc_feature: HIJSMM301AU30K.12.71.G05.1.454.light.4.raw

SEQ ID NO: 580040 - DNA, 488 bp, Homo sapiens; identical to SEQ ID NO: 558711
  misc_feature: HIJSMM301BCWZ8.40.83.H06.1.454.light.4.raw

SEQ ID NO: 580041 - DNA, 506 bp, Homo sapiens; identical to SEQ ID NO: 542696
  misc_feature: HIJSMM301B1ROI.7.71.G05.1.454.light.4.raw

SEQ ID NO: 580042 - DNA, 507 bp, Homo sapiens
  misc_feature: HIJSMM301DL4M0.9.71.G05.1.454.light.4.raw
tgatacgtctcacgaccggtgctcgatttagtgtcgtcgcaagagagaggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacatctctgggctccagtctgacgacgaggctgattattactgcagctcatatgctagttggttcctctttcaagattattcggcggagggaccaggctgacccgtcctgagtcagcccaaggctcgccccccg

SEQ ID NO: 580043 - DNA, 516 bp, Homo sapiens; identical to SEQ ID NO: 535549
  misc_feature: HIJSMM301B661R.14.70.G04.1.454.light.4.raw

SEQ ID NO: 580044 - DNA, 497 bp, Homo sapiens; identical to SEQ ID NO: 536371
  misc_feature: HIJSMM301EPO4X.16.78.H01.1.454.light.4.raw

SEQ ID NO: 580045 - DNA, 503 bp, Homo sapiens
  misc_feature: HIJSMM301C03EV.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaacccactgtcta

SEQ ID NO: 580046 - DNA, 444 bp, Homo sapiens; identical to SEQ ID NO: 540477
  misc_feature: HIJSMM301CT7LA.17.21.B10.1.454.light.4.raw

SEQ ID NO: 580047 - DNA, 485 bp, Homo sapiens
  misc_feature: HIJSMM301A2SAC.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgtttccgccctcctcgctacgtaga

SEQ ID NO: 580048 - DNA, 483 bp, Homo sapiens
  misc_feature: HIJSMM301AOPTT.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaacggtggaaatacaaacgaactagtggctgcacca

SEQ ID NO: 580049 - DNA, 506 bp, Homo sapiens
  misc_feature: HIJSMM301ECE95.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgtcccta

SEQ ID NO: 580050 - DNA, 516 bp, Homo sapiens
  misc_feature: HIJSMM301EOUQS.41.35.D02.1.454.light.4.raw
tctatactatcacgaccggtgctcgatttagcacacgatagttgggtttggggagtctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccg

SEQ ID NO: 580051 - DNA, 492 bp, Homo sapiens; identical to SEQ ID NO: 537395
  misc_feature: HIJSMM301C1YWH.16.73.G07.1.454.light.4.raw

SEQ ID NO: 580052 - DNA, 509 bp, Homo sapiens
  misc_feature: HIJSMM301ENPC1.43.5.A05.1.454.light.4.raw
tgtgagtagtcacgaccggtgctcgatttagatagatagacaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgacccttcgggtgcgcagcctgaggatgaggctgactattactgcttgctcgcctatgatgctgctcgggttttcgcggagggccaagttgaccgtcctaggtcagcccaaggctgccccctcggtcactctgttcccaccctcctca

SEQ ID NO: 580053 - DNA, 466 bp, Homo sapiens; identical to SEQ ID NO: 535366
  misc_feature: HIJSMM301B0LD3.13.4.A04.1.454.light.4.raw

SEQ ID NO: 580054 - DNA, 486 bp, Homo sapiens
  misc_feature: HIJSMM301AJ30Y.12.31.C09.1.454.light.4.raw
  modified_base (426)..(426): a, c, t, g, unknown or other
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgcaccagtctgcaagtgggttcccgtcaaggttcactggccgtggatcagggacagaatttactctcaccatcagtagtctacagcctgaagatattgctacttattactgtcagcagagttaccncgctcccatcactttcggccaggacacgaccgcagattggacgaaacctgtggctgcacc

SEQ ID NO: 580055 - DNA, 512 bp, Homo sapiens
  misc_feature: HIJSMM301DZ3A4.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaacggtggagagtcaaacgaactcgtggctgcaccatctgtcttcta

SEQ ID NO: 580056 - DNA, 478 bp, Homo sapiens; identical to SEQ ID NO: 541915
  misc_feature: HIJSMM301BPCZI.13.59.F04.1.454.light.4.raw

SEQ ID NO: 580057 - DNA, 494 bp, Homo sapiens; identical to SEQ ID NO: 534992
  misc_feature: HIJSMM301BQOY0.9.1.A01.1.454.light.4.raw

SEQ ID NO: 580058 - DNA, 512 bp, Homo sapiens
  misc_feature: HIJSMM301CS49H.15.34.D01.1.454.light.4.raw
tctacgtagccacgaccggtgctcgatttagatcgtctgtgttggggttgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccgggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctcg

SEQ ID NO: 580059 - DNA, 488 bp, Homo sapiens; identical to SEQ ID NO: 542699
  misc_feature: HIJSMM301AO6O1.12.51.E07.1.454.light.4.raw

SEQ ID NO: 580060 - DNA, 498 bp, Homo sapiens; identical to SEQ ID NO: 564169
  misc_feature: HIJSMM301E0WF3.3.71.G05.1.454.light.4.raw

SEQ ID NO: 580061 - DNA, 490 bp, Homo sapiens; identical to SEQ ID NO: 537951
  misc_feature: HIJSMM301ARMKO.19.57.F02.1.454.light.4.raw

SEQ ID NO: 580062 - DNA, 505 bp, Homo sapiens
  misc_feature: HIJSMM301EMKNI.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcgaggggtccctgatcgcttctctggctccaagtctggcaacacggcctccctgaccgtctctgggctccagactgaggatgaggctgactattactgcagctctatttgcaggcagccgtatactcttcggcggagggaccaagctgaccgtctaggtcagcccaaggcctcgccccctcc

SEQ ID NO: 580063 - DNA, 514 bp, Homo sapiens; identical to SEQ ID NO: 546238
  misc_feature: HIJSMM301BEJDF.47.85.H08.1.454.light.4.raw

SEQ ID NO: 580064 - DNA, 494 bp, Homo sapiens; identical to SEQ ID NO: 534994
  misc_feature: HIJSMM301CQQH5.27.78.H01.1.454.light.4.raw

SEQ ID NO: 580065 - DNA, 492 bp, Homo sapiens; identical to SEQ ID NO: 558722
  misc_feature: HIJSMM301AO5GT.43.72.G06.1.454.light.4.raw

SEQ ID NO: 580066 - DNA, 494 bp, Homo sapiens; identical to SEQ ID NO: 549948
  misc_feature: HIJSMM301BHAA2.16.53.E09.1.454.light.4.raw

SEQ ID NO: 580067 - DNA, 471 bp, Homo sapiens; identical to SEQ ID NO: 536321
  misc_feature: HIJSMM301CJNAA.15.8.A08.1.454.light.4.raw

SEQ ID NO: 580068 - DNA, 496 bp, Homo sapiens; identical to SEQ ID NO: 537513
  misc_feature: HIJSMM301DXIBK.12.87.H10.1.454.light.4.raw

SEQ ID NO: 580069 - DNA, 521 bp, Homo sapiens; identical to SEQ ID NO: 539470
  misc_feature: HIJSMM301AMP2U.27.23.C01.1.454.light.4.raw

SEQ ID NO: 580070 - DNA, 487 bp, Homo sapiens; identical to SEQ ID NO: 538190
  misc_feature: HIJSMM301DLEVJ.47.70.G04.1.454.light.4.raw

SEQ ID NO: 580071 - DNA, 498 bp, Homo sapiens
  misc_feature: HIJSMM301C5Z0V.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggaccagatttcactctcaccatcaccaacctgcaggctgaagatgtggcagtttattactgtcagcaatactatagtcctccttctcacgttcgcggagggaccaaggtggagatcaaacgaactgtggctgcaccatctgtcttcatcttcccgccatctgac

SEQ ID NO: 580072 - DNA, 507 bp, Homo sapiens
  misc_feature: HIJSMM301CJJ43.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtaggaaatacaaacgaactagtggctgcaccatctgtcttcatcttccccg

SEQ ID NO: 580073 - DNA, 487 bp, Homo sapiens
  misc_feature: HIJSMM301AKUAL.5.42.D09.1.454.light.4.raw
atcagacacgcacgaccggtgctcgatttagacacatacgcagggaaaggggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggtccaggggacgaaggtcgaaatgagacgaactgtggctgcaccatctgtt

SEQ ID NO: 580074 - DNA, 509 bp, Homo sapiens
  misc_feature: HIJSMM301DL6EF.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgctagtttattactgtcaacagcgtagcagcaggcctccggcgacgttcggccaagggaccaaggtggaagtcaagcgaactgtggctgcaccatctgtcttcatcttcccgcc

SEQ ID NO: 580075 - DNA, 514 bp, Homo sapiens; identical to SEQ ID NO: 545978
  misc_feature: HIJSMM301AQWT4.17.33.C11.1.454.light.4.raw

SEQ ID NO: 580076 - DNA, 513 bp, Homo sapiens
  misc_feature: HIJSMM301EDINQ.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagccaaggctgccccctcggtcactctgttccccg

SEQ ID NO: 580077 - DNA, 497 bp, Homo sapiens
  misc_feature: HIJSMM301CA0MA.51.49.E05.1.454.light.4.raw
cgatcgtatacacgaccggtgctcgatttagagcgactagcaacacacaaagggggaggaactgctcagttaggagccagacggaaccatggaagccccagcgcagcttctcttcctcctgctactctggctcccagataccattggagagatagtgctgacgcagtctccagccaccctgtctgtgtctccaggggagagagtcaccctctcctgcagggcctctgagaatatagatatctacttggtctggtaccagcaaaaacctggccagcctcccaggctcctcgtccatagtgcctccgccagggccgctggtgtcccagccaggttccgaggcagtcggtctgggacagagttcactctcaccattaccaacctgcagtctgaagattttggactttattactgtcagcagtataatgactggcctaggacgttcggccaagggaccagggtggaatcaagcgaactgtggctgcaccatctgtcttcta

SEQ ID NO: 580078 - DNA, 454 bp, Homo sapiens; identical to SEQ ID NO: 535005
  misc_feature: HIJSMM301AECID.19.86.H09.1.454.light.4.raw

SEQ ID NO: 580079 - DNA, 483 bp, Homo sapiens; identical to SEQ ID NO: 547051
  misc_feature: HIJSMM301CX5XG.46.26.C04.1.454.light.4.raw

SEQ ID NO: 580080 - DNA, 522 bp, Homo sapiens
  misc_feature: HIJSMM301DDDPQ.27.23.C01.1.454.light.4.raw
agcgtcgtctcacgaccggtgctcgatttagtacacgtgattagggattggggggggtctcaggaggcagcgctctcgggacgtcctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaacacattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 580081 - DNA, 493 bp, Homo sapiens
  misc_feature: HIJSMM301CM525.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctggactattattgtcaatcaacagacaccattggacttatgtcttcggaactgcgaccaaggtcaccgtctgggtcagcccaaggccaacccactgtctac

SEQ ID NO: 580082 - DNA, 444 bp, Homo sapiens; identical to SEQ ID NO: 535192
  misc_feature: HIJSMM301ECR88.5.9.A09.1.454.light.4.raw

SEQ ID NO: 580083 - DNA, 486 bp, Homo sapiens; identical to SEQ ID NO: 535385
  misc_feature: HIJSMM301AK5QP.19.71.G05.1.454.light.4.raw

SEQ ID NO: 580084 - DNA, 498 bp, Homo sapiens
  misc_feature: HIJSMM301CZBJP.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgatgctgattactactgctgctcatatgcaggtcgtatctcttatgtcttcggaactgggaccaaggtcaccgtctaggtcagcccaaggccaaccccactgtcactctgttcccgccctcctccacgagagta

SEQ ID NO: 580085 - DNA, 491 bp, Homo sapiens
  misc_feature: HIJSMM301AGWF7.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaatcagcagggtggaggctgaggatgttattgggctctattattgcatgcaagcaacacactggccgtacacttttggccaggggaccaagctggagatcaatcgaactgtgg

SEQ ID NO: 580086 - DNA, 422 bp, Homo sapiens; identical to SEQ ID NO: 539229
  misc_feature: HIJSMM301B38H7.41.15.B04.1.454.light.4.raw

SEQ ID NO: 580087 - DNA, 449 bp, Homo sapiens
  misc_feature: HIJSMM301BXLKJ.18.9.A09.1.454.light.4.raw
  modified_base (431)..(431): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgcctagtcctatgacatgaggctgagtggttcgtatgtcttcggatctgggaccaaggtcaccgtcctaagtcagcccaaggccaacccctctgtcactctcgttcccnccctcctccatactcgta

SEQ ID NO: 580088 - DNA, 500 bp, Homo sapiens
  misc_feature: HIJSMM301DZEQX.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagcccaaggct

SEQ ID NO: 580089 - DNA, 482 bp, Homo sapiens
  misc_feature: HIJSMM301A5OLN.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattaccctcgaacgttcggccaagggaccaaggtggaagtcaaacgaactagtggctgcaccat

SEQ ID NO: 580090 - DNA, 507 bp, Homo sapiens
  misc_feature: HIJSMM301BM6WY.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgtttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgacgtcctaggcagcccaaggctgtccccccg

SEQ ID NO: 580091 - DNA, 516 bp, Homo sapiens
  misc_feature: HIJSMM301CFVZE.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaacgggaccgaacggtaggaaagtacaaacgaacctagtggctgcaccactactgtcttctatcttccccg

SEQ ID NO: 580092 - DNA, 491 bp, Homo sapiens
  misc_feature: HIJSMM301C5MFG.41.44.D11.1.454.light.4.raw
  modified_base (394)..(394): a, c, t, g, unknown or other
tctatactatcacgaccggtgctcgatttagcgcagtacgaagggggcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgnggatgaggctgactactattgcacggtctggtacagcagcgctgtggtcttcgggcggagggactgaacttatcgtcctaggtcagcccaaggctcg

SEQ ID NO: 580093 - DNA, 487 bp, Homo sapiens; identical to SEQ ID NO: 537208
  misc_feature: HIJSMM301BY51Z.3.55.E11.1.454.light.4.raw

SEQ ID NO: 580094 - DNA, 504 bp, Homo sapiens; identical to SEQ ID NO: 535495
  misc_feature: HIJSMM301AMBVE.14.86.H09.1.454.light.4.raw

SEQ ID NO: 580095 - DNA, 486 bp, Homo sapiens; identical to SEQ ID NO: 535290
  misc_feature: HIJSMM301CQRCS.3.12.B01.1.454.light.4.raw

SEQ ID NO: 580096 - DNA, 489 bp, Homo sapiens
  misc_feature: HIJSMM301DHSWQ.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 580097 - DNA, 506 bp, Homo sapiens; identical to SEQ ID NO: 563474
  misc_feature: HIJSMM301BVHAZ.10.27.C05.1.454.light.4.raw

SEQ ID NO: 580098 - DNA, 476 bp, Homo sapiens
  misc_feature: HIJSMM301EJ52V.7.59.F04.1.454.light.4.raw
  modified_base (446)..(446): a, c, t, g, unknown or other
  modified_base (457)..(457): a, c, t, g, unknown or other
  modified_base (471)..(471): a, c, t, g, unknown or other
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaaggttcagcggcagtgaaaactgggacagaaattcattctcaccatcagcagcctgcagcctgatgattttgccaattattactgcaacatataagagtatctggagtcgcgacgacgagnggaagaagaanaacgaatgagtgcncacac

SEQ ID NO: 580099 - DNA, 493 bp, Homo sapiens
  misc_feature: HIJSMM301ALXV8.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattatatacttcgtggacgttcggccaaggaccaaggtggatatcagacgaactgtggctg

SEQ ID NO: 580100 - DNA, 517 bp, Homo sapiens
  misc_feature: HIJSMM301D0C0A.10.86.H09.1.454.light.4.raw
catagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctccagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 580101 - DNA, 488 bp, Homo sapiens; identical to SEQ ID NO: 535990
  misc_feature: HIJSMM301CBZZS.11.28.C06.1.454.light.4.raw

SEQ ID NO: 580102 - DNA, 505 bp, Homo sapiens
  misc_feature: HIJSMM301D9SWX.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncggggcttcggccaagggaccaaggtgggaaatacaaacgaactgtggctgcaccatctgtcttcatcttccccg

SEQ ID NO: 580103 - DNA, 487 bp, Homo sapiens
  misc_feature: HIJSMM301DC31F.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggcctaggggaccaagctggagatcaacgaa

SEQ ID NO: 580104 - DNA, 503 bp, Homo sapiens; identical to SEQ ID NO: 538884
  misc_feature: HIJSMM301A0AR7.27.78.H01.1.454.light.4.raw

SEQ ID NO: 580105 - DNA, 515 bp, Homo sapiens; identical to SEQ ID NO: 541016
  misc_feature: HIJSMM301DHWHT.43.23.C01.1.454.light.4.raw

SEQ ID NO: 580106 - DNA, 496 bp, Homo sapiens
  misc_feature: HIJSMM301B66PP.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccgaaggtggagagtcaaacgaactgtggctgcaccatctgtt

SEQ ID NO: 580107 - DNA, 492 bp, Homo sapiens
  misc_feature: HIJSMM301AP2S9.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagacgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggtccaggggaccgaaactggatatcagacgaactgtggctgca

SEQ ID NO: 580108 - DNA, 505 bp, Homo sapiens
  misc_feature: HIJSMM301EGKBX.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggccttcggacgttcggtccgaacgggaaccgaacggtagggaaatacaaaacgaactagtggctggcaccactcttcg

SEQ ID NO: 580109 - DNA, 521 bp, Homo sapiens; identical to SEQ ID NO: 538715
  misc_feature: HIJSMM301D722J.27.23.C01.1.454.light.4.raw

SEQ ID NO: 580110 - DNA, 485 bp, Homo sapiens; identical to SEQ ID NO: 536075
  misc_feature: HIJSMM301BX5WD.17.21.B10.1.454.light.4.raw

SEQ ID NO: 580111 - DNA, 459 bp, Homo sapiens
  misc_feature: HIJSMM301DSTN0.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctggtcactctgttcccaccctcctcacgcgtatgt

SEQ ID NO: 580112 - DNA, 487 bp, Homo sapiens; identical to SEQ ID NO: 537573
  misc_feature: HIJSMM301CUG2F.3.10.A10.1.454.light.4.raw

SEQ ID NO: 580113 - DNA, 494 bp, Homo sapiens; identical to SEQ ID NO: 543462
  misc_feature: HIJSMM301BMN5J.12.38.D05.1.454.light.4.raw

SEQ ID NO: 580114 - DNA, 445 bp, Homo sapiens
  misc_feature: HIJSMM301DDIVA.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttccccaccctcctcgacacgcgag

SEQ ID NO: 580115 - DNA, 484 bp, Homo sapiens; identical to SEQ ID NO: 535400
  misc_feature: HIJSMM301CX164.46.26.C04.1.454.light.4.raw

SEQ ID NO: 580116 - DNA, 494 bp, Homo sapiens
  misc_feature: HIJSMM301BEURV.27.78.H01.1.454.light.4.raw
  modified_base (483)..(483): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcnccatctgtctt

SEQ ID NO: 580117 - DNA, 505 bp, Homo sapiens; identical to SEQ ID NO: 535987
  misc_feature: HIJSMM301EYP6P.18.37.D04.1.454.light.4.raw

SEQ ID NO: 580118 - DNA, 493 bp, Homo sapiens
  misc_feature: HIJSMM301DPC1I.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaggcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtctaggtcagcccaagg

SEQ ID NO: 580119 - DNA, 511 bp, Homo sapiens; identical to SEQ ID NO: 537047
  misc_feature: HIJSMM301C885O.5.27.C05.1.454.light.4.raw

SEQ ID NO: 580120 - DNA, 503 bp, Homo sapiens
  misc_feature: HIJSMM301EDNY5.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggagggacccaaatgaccgtcctaggtcagcccaa

SEQ ID NO: 580121 - DNA, 487 bp, Homo sapiens; identical to SEQ ID NO: 539157
  misc_feature: HIJSMM301C48ZU.26.37.D04.1.454.light.4.raw

SEQ ID NO: 580122 - DNA, 487 bp, Homo sapiens; identical to SEQ ID NO: 537079
  misc_feature: HIJSMM301CGBMV.14.55.E11.1.454.light.4.raw

SEQ ID NO: 580123 - DNA, 485 bp, Homo sapiens; identical to SEQ ID NO: 536040
  misc_feature: HIJSMM301DMVPG.15.1.A01.1.454.light.4.raw

SEQ ID NO: 580124 - DNA, 502 bp, Homo sapiens; identical to SEQ ID NO: 567410
  misc_feature: HIJSMM301DHRVD.15.1.A01.1.454.light.4.raw

SEQ ID NO: 580125 - DNA, 468 bp, Homo sapiens; identical to SEQ ID NO: 555808
  misc_feature: HIJSMM301AYYTG.3.68.G02.1.454.light.4.raw

SEQ ID NO: 580126 - DNA, 504 bp, Homo sapiens
  misc_feature: HIJSMM301CWC55.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgtaggctgaagatgtggcagtttattactgtcaacagttttctcgggcgttcggccaagggaccaaggtgggaaatcaaacgaactagtggctgcaccatctgtcttcactcttcccg

SEQ ID NO: 580127 - DNA, 488 bp, Homo sapiens
  misc_feature: HIJSMM301DRIG4.26.55.E11.1.454.light.4.raw
agactatactcacgaccggtgctcgatttagcactcgcacgttgggtttgggggcaggagtccagtctcagtcagggacacagcatggacatgtgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaagctggagatcacaggaactgtggctgcacc

SEQ ID NO: 580128 - DNA, 523 bp, Homo sapiens
  misc_feature: HIJSMM301AP10L.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcgctagtac

SEQ ID NO: 580129 - DNA, 485 bp, Homo sapiens
  misc_feature: HIJSMM301DYJDB.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggatttgcaacttactactgtcaacagagttacaggcccccctatacttttggccaggggaccaagctggagatcacaggaactgtggctgcacc

SEQ ID NO: 580130 - DNA, 507 bp, Homo sapiens; identical to SEQ ID NO: 560339
  misc_feature: HIJSMM301BPVKV.47.83.H06.1.454.light.4.raw

SEQ ID NO: 580131 - DNA, 505 bp, Homo sapiens
  misc_feature: HIJSMM301DJ7HT.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtca

SEQ ID NO: 580132 - DNA, 488 bp, Homo sapiens
  misc_feature: HIJSMM301DUNW7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggagtatcagacgaa

SEQ ID NO: 580133 - DNA, 500 bp, Homo sapiens
  misc_feature: HIJSMM301EP7L2.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactctttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcggccaagggaccaaggtggaaagtcaaacgaactgtaggctgcaccatctgtcttcatcttcccgccat

SEQ ID NO: 580134 - DNA, 448 bp, Homo sapiens; identical to SEQ ID NO: 538166
  misc_feature: HIJSMM301B93WZ.18.9.A09.1.454.light.4.raw

SEQ ID NO: 580135 - DNA, 487 bp, Homo sapiens
  misc_feature: HIJSMM301CZR36.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccgaaggtggaggatcaaacgaactgtggctgcacca

SEQ ID NO: 580136 - DNA, 499 bp, Homo sapiens
  misc_feature: HIJSMM301DX9HA.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgaggggacacgcctggagattaaacgaactgtggctgcaccat

SEQ ID NO: 580137 - DNA, 490 bp, Homo sapiens; identical to SEQ ID NO: 535526
  misc_feature: HIJSMM301CP95N.26.78.H01.1.454.light.4.raw

SEQ ID NO: 580138 - DNA, 508 bp, Homo sapiens; identical to SEQ ID NO: 554004
  misc_feature: HIJSMM301AIZBN.4.57.F02.1.454.light.4.raw

SEQ ID NO: 580139 - DNA, 503 bp, Homo sapiens; identical to SEQ ID NO: 574363
  misc_feature: HIJSMM301EULHK.2.35.D02.1.454.light.4.raw

SEQ ID NO: 580140 - DNA, 482 bp, Homo sapiens; identical to SEQ ID NO: 544520
  misc_feature: HIJSMM301C5SOD.49.28.C06.1.454.light.4.raw

SEQ ID NO: 580141 - DNA, 454 bp, Homo sapiens; identical to SEQ ID NO: 535005
  misc_feature: HIJSMM301AYYJO.19.86.H09.1.454.light.4.raw

SEQ ID NO: 580142 - DNA, 504 bp, Homo sapiens; identical to SEQ ID NO: 539032
  misc_feature: HIJSMM301D4M3B.19.67.G01.1.454.light.4.raw

SEQ ID NO: 580143 - DNA, 494 bp, Homo sapiens; identical to SEQ ID NO: 566736
  misc_feature: HIJSMM301C6M2U.26.72.G06.1.454.light.4.raw

SEQ ID NO: 580144 - DNA, 494 bp, Homo sapiens; identical to SEQ ID NO: 534992
  misc_feature: HIJSMM301D87SO.9.1.A01.1.454.light.4.raw

SEQ ID NO: 580145 - DNA, 510 bp, Homo sapiens
  misc_feature: HIJSMM301C0VJN.15.8.A08.1.454.light.4.raw
tctacgtagccacgaccggtgctcgatttagcatactctacagggggaggaactgctcagttaggacccagacggaaccatggaagccccagcgcagcttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattctacttcgtcccgacggaccgaaacgtaggtagtatactaacgaaacctaagtaggtcgtcgtcaccactctgttcttcttact

SEQ ID NO: 580146 - DNA, 505 bp, Homo sapiens
  misc_feature: HIJSMM301B98HP.12.53.E09.1.454.light.4.raw
atacgacgtacacgaccggtgctcgatttagagagagtgtgttgggtttgggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtctggtcagccaagctgccctcc

SEQ ID NO: 580147 - DNA, 512 bp, Homo sapiens
  misc_feature: HIJSMM301A0YGO.51.86.H09.1.454.light.4.raw
  modified_base (502)..(502): a, c, t, g, unknown or other
cgatcgtatacacgaccggtgctcgatttagtgctatagacttgggtttgggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaacggtggaaatcaaacgaactagtggctgcaccanctgtcttcta

SEQ ID NO: 580148 - DNA, 447 bp, Homo sapiens
  misc_feature: HIJSMM301AX8RV.18.9.A09.1.454.light.4.raw
  modified_base (412)..(412): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaggtcagcccaaggccaaccccnctgtcactctgttcccgccctcctccatactcgta

SEQ ID NO: 580149 - DNA, 474 bp, Homo sapiens
  misc_feature: HIJSMM301BSMR4.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggccctggactgaagtgcatatgaagagaactgtggctgca

SEQ ID NO: 580150 - DNA, 491 bp, Homo sapiens
  misc_feature: HIJSMM301AHQ43.41.68.G02.1.454.light.4.raw
tctatactatcacgaccggtgctcgatttagtcgatagtgaagggaaagggcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcgcggaggaccgaa

SEQ ID NO: 580151 - DNA, 512 bp, Homo sapiens; identical to SEQ ID NO: 557832
  misc_feature: HIJSMM301EMYYU.7.34.D01.1.454.light.4.raw

SEQ ID NO: 580152 - DNA, 496 bp, Homo sapiens
  misc_feature: HIJSMM301A7TF3.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggccgaagggaccgaaggtaggaaagtacaaacgaaactagtggcgtgcaccatctgtctt

SEQ ID NO: 580153 - DNA, 484 bp, Homo sapiens
  misc_feature: HIJSMM301BBWEF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaacttttggccaggggaccaagctggagatcaaacgaactgtggctgcacat

SEQ ID NO: 580154 - DNA, 496 bp, Homo sapiens; identical to SEQ ID NO: 553382
  misc_feature: HIJSMM301ELGG2.51.59.F04.1.454.light.4.raw

SEQ ID NO: 580155 - DNA, 483 bp, Homo sapiens
  misc_feature: HIJSMM301B8XQC.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaagccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcgacgaccccg

SEQ ID NO: 580156 - DNA, 484 bp, Homo sapiens; identical to SEQ ID NO: 546338
  misc_feature: HIJSMM301AR0E7.52.69.G03.1.454.light.4.raw

SEQ ID NO: 580157 - DNA, 518 bp, Homo sapiens; identical to SEQ ID NO: 535407
  misc_feature: HIJSMM301BXNUG.22.30.C08.1.454.light.4.raw

SEQ ID NO: 580158 - DNA, 494 bp, Homo sapiens; identical to SEQ ID NO: 537607
  misc_feature: HIJSMM301C7G51.52.10.A10.1.454.light.4.raw

SEQ ID NO: 580159 - DNA, 474 bp, Homo sapiens
  misc_feature: HIJSMM301BE5L9.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctccactttcggcggaggaccaaggtggagatcaaacgaactgtggctgcaccatctgt

SEQ ID NO: 580160 - DNA, 507 bp, Homo sapiens
  misc_feature: HIJSMM301BU2BU.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctcgccccctcggtcactctcgttcccgccctcctcg

SEQ ID NO: 580161 - DNA, 486 bp, Homo sapiens; identical to SEQ ID NO: 535043
  misc_feature: HIJSMM301AROX1.46.35.D02.1.454.light.4.raw

SEQ ID NO: 580162 - DNA, 489 bp, Homo sapiens
  misc_feature: HIJSMM301B8UT5.43.61.F06.1.454.light.4.raw
  modified_base (400)..(400): a, c, t, g, unknown or other
tgtgagtagtcacgaccggtgctcgatttagctacgctctaagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttnttactgtctacaagattcttcttaccctcggacgttcggtccacggggaccgacggtggagtgtctaagacgaactgtggctgcaccat

SEQ ID NO: 580163 - DNA, 487 bp, Homo sapiens
  misc_feature: HIJSMM301BU9CL.15.28.C06.1.454.light.4.raw
tctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccgaaggtggagatcaaacgaactgtggctgcaccatctgtcttcat

SEQ ID NO: 580164 - DNA, 490 bp, Homo sapiens; identical to SEQ ID NO: 535234
  misc_feature: HIJSMM301A7EDQ.17.21.B10.1.454.light.4.raw

SEQ ID NO: 580165 - DNA, 504 bp, Homo sapiens
  misc_feature: HIJSMM301CLBX4.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaataagaggtcaaacgaactagtggctgcaccatctgtcttcat

SEQ ID NO: 580166 - DNA, 464 bp, Homo sapiens
  misc_feature: HIJSMM301C68ON.51.11.A11.1.454.light.4.raw
cgatcgtatacacgaccggtgctcgatttagctacgactgcagggggcaggagtcagtcccaaccaggacacagcatggacatagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcgagggaccaaggtggagatcaaacgaa

SEQ ID NO: 580167 - DNA, 496 bp, Homo sapiens; identical to SEQ ID NO: 535541
  misc_feature: HIJSMM301A7MNU.3.33.C11.1.454.light.4.raw

SEQ ID NO: 580168 - DNA, 472 bp, Homo sapiens
  misc_feature: HIJSMM301D46EM.5.36.D03.1.454.light.4.raw
atcagacacgcacgaccggtgctcgatttagctgcgtcacgatctctcttggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtgg

SEQ ID NO: 580169 - DNA, 503 bp, Homo sapiens
  misc_feature: HIJSMM301BTTR6.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgcccccctggtcctacc

SEQ ID NO: 580170 - DNA, 490 bp, Homo sapiens; identical to SEQ ID NO: 563993
  misc_feature: HIJSMM301ES180.4.24.C02.1.454.light.4.raw

SEQ ID NO: 580171 - DNA, 487 bp, Homo sapiens
  misc_feature: HIJSMM301CPM2P.48.12.B01.1.454.light.4.raw
agtatacatacacgaccggtgctcgatttagtagtgtagattccgcgggggctgctcagttaggacccagagggaaccatggaaaccccagcgcagcttctcttcctcctgctactctggctcccagatactaccggagaagttctgttgacgcagtctccaggcaccctgtctttgtctccaggggaaagagccaccctctcctgcagggccagtcagactgttatcagcagctccttagcctggtaccagcagaaacctggccaggctcccaggctcctcatctatggtgcatccagcagggccgctggcatcccagacaggtttagtggcagtgggtctgggacagacttcactctcaccatcagcagactggagcctgaagattttgcagtgtatttctgtcagcagtatggtggctcacccgcgtacagttttggtccaggggaccgaagctggaggatcaagcgaactgtggctgcaccat

SEQ ID NO: 580172 - DNA, 512 bp, Homo sapiens
  misc_feature: HIJSMM301C43YN.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaaggggtcggatccctgatcgcttctcgggctccagctctggggccagcgctacctcaccatctccagcctccagtctgaagatgaggctgactattactgtcagacatgggacgctggcgtctgggctggttcggcggagggaccaagctgaccgtcctaggtcagcccaaggctgccccctggtcactctgttcccaccctcctc

SEQ ID NO: 580173 - DNA, 521 bp, Homo sapiens; identical to SEQ ID NO: 539470
  misc_feature: HIJSMM301DU7FA.27.23.C01.1.454.light.4.raw

SEQ ID NO: 580174 - DNA, 494 bp, Homo sapiens; identical to SEQ ID NO: 535276
  misc_feature: HIJSMM301EP4SR.16.6.A06.1.454.light.4.raw

SEQ ID NO: 580175 - DNA, 487 bp, Homo sapiens
  misc_feature: HIJSMM301EWPT7.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagatttttactttcaccatcagcagcctgcagcctgaagatattgcaacatattactgtcaacagtatcataatctccccactttcggccctgggaccaaagtaggatatcaaacgaactgtggctgcaccatctgt

SEQ ID NO: 580176 - DNA, 505 bp, Homo sapiens; identical to SEQ ID NO: 538422
  misc_feature: HIJSMM301CJFUF.19.78.H01.1.454.light.4.raw

SEQ ID NO: 580177 - DNA, 491 bp, Homo sapiens; identical to SEQ ID NO: 535176
  misc_feature: HIJSMM301EBXPH.13.39.D06.1.454.light.4.raw

SEQ ID NO: 580178 - DNA, 501 bp, Homo sapiens; identical to SEQ ID NO: 540528
  misc_feature: HIJSMM301DMR2U.11.31.C09.1.454.light.4.raw

SEQ ID NO: 580179 - DNA, 521 bp, Homo sapiens
  misc_feature: HIJSMM301AI42A.17.28.C06.1.454.light.4.raw
cgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgttggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactccgttcccgccctcct

SEQ ID NO: 580180 - DNA, 507 bp, Homo sapiens; identical to SEQ ID NO: 559118
  misc_feature: HIJSMM301AE5KW.17.87.H10.1.454.light.4.raw

SEQ ID NO: 580181 - DNA, 490 bp, Homo sapiens
  misc_feature: HIJSMM301CKFSN.51.71.G05.1.454.light.4.raw
cgatcgtatacacgaccggtgctcgatttagtgtcgtcgcaagagagagggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcacg

SEQ ID NO: 580182 - DNA, 447 bp, Homo sapiens; identical to SEQ ID NO: 535201
  misc_feature: HIJSMM301EPQTU.18.9.A09.1.454.light.4.raw

SEQ ID NO: 580183 - DNA, 517 bp, Homo sapiens
  misc_feature: HIJSMM301EN3MN.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttccc

SEQ ID NO: 580184 - DNA, 505 bp, Homo sapiens
  misc_feature: HIJSMM301BKFA2.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatctttagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgccta

SEQ ID NO: 580185 - DNA, 506 bp, Homo sapiens; identical to SEQ ID NO: 544918
  misc_feature: HIJSMM301EGG25.8.1.A01.1.454.light.4.raw

SEQ ID NO: 580186 - DNA, 478 bp, Homo sapiens; identical to SEQ ID NO: 535129
  misc_feature: HIJSMM301B2YCC.11.11.A11.1.454.light.4.raw

SEQ ID NO: 580187 - DNA, 476 bp, Homo sapiens
  misc_feature: HIJSMM301DE96N.51.55.E11.1.454.light.4.raw
cgatcgtatacacgaccggtgctcgatttagcactcgcacgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcacttttcggcgggggaccgaaggtggagatcaagcgaactgtggctgca

SEQ ID NO: 580188 - DNA, 487 bp, Homo sapiens
  misc_feature: HIJSMM301ELJ9D.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtctaggtcagcccaaggctgccccctggtcactctgttcccaccctcctc

SEQ ID NO: 580189 - DNA, 479 bp, Homo sapiens; identical to SEQ ID NO: 537141
  misc_feature: HIJSMM301EVBEO.7.76.G10.1.454.light.4.raw

SEQ ID NO: 580190 - DNA, 454 bp, Homo sapiens; identical to SEQ ID NO: 536347
  misc_feature: HIJSMM301D02ID.19.86.H09.1.454.light.4.raw

SEQ ID NO: 580191 - DNA, 497 bp, Homo sapiens
  misc_feature: HIJSMM301B7F8A.3.78.H01.1.454.light.4.raw
agacgcactccacgaccggtgctcgatttagtgtgagtagtttgggtttgggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgctagtttattactgtcagcagcgtagcaactggctgatcaccttcggccaagggacacgactggagattaaacgaactgtggctgcaccatctgtcttcta

SEQ ID NO: 580192 - DNA, 494 bp, Homo sapiens
  misc_feature: HIJSMM301DKWGA.48.73.G07.1.454.light.4.raw
agtatacatacacgaccggtgctcgatttagctctacgctcagggcacgaccggtgctcgatttagagctcacgtattgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgtagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccg

SEQ ID NO: 580193 - DNA, 479 bp, Homo sapiens
  misc_feature: HIJSMM301BNJD6.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctccctcgagtagtaca

SEQ ID NO: 580194 - DNA, 502 bp, Homo sapiens; identical to SEQ ID NO: 543913
  misc_feature: HIJSMM301ETBJC.18.26.C04.1.454.light.4.raw

SEQ ID NO: 580195 - DNA, 511 bp, Homo sapiens
  misc_feature: HIJSMM301DTTEO.8.33.C11.1.454.light.4.raw
ctcgcgtgtccacgaccggtgctcgatttagagtgagctcgttgggtttgggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgctagtttattactgtcaacatcgtaccgagtggccgtccggggccactttcggcccgtcgggaccgaaggtggagatacaaacgaactgtggctgcaccatctgtcttcatt

SEQ ID NO: 580196 - DNA, 503 bp, Homo sapiens
  misc_feature: HIJSMM301E0FXT.48.35.D02.1.454.light.4.raw
agtatacatacacgaccggtgctcgatttagcacacgatagttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggcctgccccctcggtcactctgtt

SEQ ID NO: 580197 - DNA, 487 bp, Homo sapiens
  misc_feature: HIJSMM301BBLVJ.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggaggaccgaaggtggaggatacaaacgaaa

SEQ ID NO: 580198 - DNA, 496 bp, Homo sapiens
  misc_feature: HIJSMM301EBPTR.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgcat

SEQ ID NO: 580199 - DNA, 484 bp, Homo sapiens; identical to SEQ ID NO: 536162
  misc_feature: HIJSMM301CN67S.13.59.F04.1.454.light.4.raw

SEQ ID NO: 580200 - DNA, 479 bp, Homo sapiens; identical to SEQ ID NO: 539141
  misc_feature: HIJSMM301BVHCA.7.67.G01.1.454.light.4.raw

SEQ ID NO: 580201 - DNA, 496 bp, Homo sapiens
  misc_feature: HIJSMM301DQOGX.16.70.G04.1.454.light.4.raw
tgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtatcccagccaggttcagtggcagtgggtctgggacagagttcactctcaccatcagcagcctgcagtctgaagattttgcagtttattactgtcagcaatataatgactggcctccgctcactttcggcggagggaccaaggtggagatcaaacgaactgtggctgcaccatctgtcttcta

SEQ ID NO: 580202 - DNA, 496 bp, Homo sapiens; identical to SEQ ID NO: 535541
  misc_feature: HIJSMM301BHVLY.3.33.C11.1.454.light.4.raw

SEQ ID NO: 580203 - DNA, 499 bp, Homo sapiens
  misc_feature: HIJSMM301AU67S.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcacatctgtcttcatcttcccgccat

SEQ ID NO: 580204 - DNA, 518 bp, Homo sapiens; identical to SEQ ID NO: 561872
  misc_feature: HIJSMM301BH1VK.14.70.G04.1.454.light.4.raw

SEQ ID NO: 580205 - DNA, 504 bp, Homo sapiens; identical to SEQ ID NO: 535561
  misc_feature: HIJSMM301CZZTX.4.57.F02.1.454.light.4.raw

SEQ ID NO: 580206 - DNA, 503 bp, Homo sapiens
  misc_feature: HIJSMM301AEDE7.11.59.F04.1.454.light.4.raw
cgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctctttcggaactgggaccacggtcaccgtcctaggtcagcccaaggcccaaccccactcgtcactctcgttcccgccctcctcgtatctctcg

SEQ ID NO: 580207 - DNA, 383 bp, Homo sapiens
  misc_feature: HIJSMM301CK1QI.41.34.D01.1.454.light.4.raw
tctatactatcacgaccggtgctcgatttagatcgtctgtgttaggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 580208 - DNA, 504 bp, Homo sapiens; identical to SEQ ID NO: 546828
  misc_feature: HIJSMM301B2J0A.7.71.G05.1.454.light.4.raw

SEQ ID NO: 580209 - DNA, 494 bp, Homo sapiens
  misc_feature: HIJSMM301CYZCZ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctctaagtgatcaccttcggccaagggacacgactggagattaaacgaactgtggctgcacatctgtctt

SEQ ID NO: 580210 - DNA, 500 bp, Homo sapiens
  misc_feature: HIJSMM301DH6K5.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtaggaaatacaaacgaactgtggctgcacc

SEQ ID NO: 580211 - DNA, 481 bp, Homo sapiens; identical to SEQ ID NO: 535993
  misc_feature: HIJSMM301AKMM4.21.25.C03.1.454.light.4.raw

SEQ ID NO: 580212 - DNA, 522 bp, Homo sapiens; identical to SEQ ID NO: 541090
  misc_feature: HIJSMM301A27J3.27.23.C01.1.454.light.4.raw

SEQ ID NO: 580213 - DNA, 484 bp, Homo sapiens; identical to SEQ ID NO: 535400
  misc_feature: HIJSMM301EKYW4.46.26.C04.1.454.light.4.raw

SEQ ID NO: 580214 - DNA, 470 bp, Homo sapiens; identical to SEQ ID NO: 547523
  misc_feature: HIJSMM301D47SP.5.28.C06.1.454.light.4.raw

SEQ ID NO: 580215 - DNA, 494 bp, Homo sapiens; identical to SEQ ID NO: 539922
  misc_feature: HIJSMM301CC9T5.27.78.H01.1.454.light.4.raw

SEQ ID NO: 580216 - DNA, 495 bp, Homo sapiens; identical to SEQ ID NO: 562352
  misc_feature: HIJSMM301BZOKZ.40.39.D06.1.454.light.4.raw

SEQ ID NO: 580217 - DNA, 504 bp, Homo sapiens; identical to SEQ ID NO: 563516
  misc_feature: HIJSMM301BXTZP.12.53.E09.1.454.light.4.raw

SEQ ID NO: 580218 - DNA, 485 bp, Homo sapiens; identical to SEQ ID NO: 536263
  misc_feature: HIJSMM301D26TF.47.78.H01.1.454.light.4.raw

SEQ ID NO: 580219 - DNA, 488 bp, Homo sapiens
  misc_feature: HIJSMM301CXUES.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggtagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatct

SEQ ID NO: 580220 - DNA, 488 bp, Homo sapiens; identical to SEQ ID NO: 539612
  misc_feature: HIJSMM301EE8A2.3.55.E11.1.454.light.4.raw

SEQ ID NO: 580221 - DNA, 485 bp, Homo sapiens; identical to SEQ ID NO: 535501
  misc_feature: HIJSMM301B8NCR.3.10.A10.1.454.light.4.raw

SEQ ID NO: 580222 - DNA, 484 bp, Homo sapiens; identical to SEQ ID NO: 535240
  misc_feature: HIJSMM301COBF7.47.60.F05.1.454.light.4.raw

SEQ ID NO: 580223 - DNA, 495 bp, Homo sapiens
  misc_feature: HIJSMM301BS0KV.10.72.G06.1.454.light.4.raw
catagtagtgcacgaccggtgctcgatttagctacgactgcaagggaaagggggggtcgtcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctgggctgaccgtcctacgtccagcccaac

SEQ ID NO: 580224 - DNA, 500 bp, Homo sapiens
  misc_feature: HIJSMM301B6OYC.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccaaactgaccgtcctaggtcagcccaaggctgtccccccg

SEQ ID NO: 580225 - DNA, 498 bp, Homo sapiens
  misc_feature: HIJSMM301B1ADM.48.38.D05.1.454.light.4.raw
agtatacatacacgaccggtgctcgatttagtatctgatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtgtattcggcggagggaccaagctgaccgtcctaggtcagcccaaggctccg

SEQ ID NO: 580226 - DNA, 494 bp, Homo sapiens; identical to SEQ ID NO: 534994
  misc_feature: HIJSMM301DPE2C.27.78.H01.1.454.light.4.raw

SEQ ID NO: 580227 - DNA, 507 bp, Homo sapiens; identical to SEQ ID NO: 561702
  misc_feature: HIJSMM301BR0YR.5.24.C02.1.454.light.4.raw

SEQ ID NO: 580228 - DNA, 474 bp, Homo sapiens
  misc_feature: HIJSMM301AON8Q.52.2.A02.1.454.light.4.raw
  modified_base (360)..(360): a, c, t, g, unknown or other
cgcagtacgacacgaccggtgctcgatttagactcatctacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttnaccatcgccagactgcagcctgaagatattgcaacatattactgtcaacagtatgataatctcccgctcactttcggcggagggaccaaggtggagatcagaacgaactagtgg

SEQ ID NO: 580229 - DNA, 490 bp, Homo sapiens
  misc_feature: HIJSMM301EGPCN.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggttcagcagaaaccagggaaagcccctaagctcctgatctatgctgcatccactttacaaatggagtcccatcaagattcagcggcagtggatctggcacagctttcactctcaccgtcagcagcctgcagtctgaagattttgcaacttattactgtctacaagtattcttcttaccctcggtaccgttcggccgtacgggaccgacggtacggatgttacaatcgaactgtggcgtgcacc

SEQ ID NO: 580230 - DNA, 487 bp, Homo sapiens
  misc_feature: HIJSMM301AZ7OZ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctgactcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctggggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 580231 - DNA, 455 bp, Homo sapiens
  misc_feature: HIJSMM301BZN78.51.1.A01.1.454.light.4.raw
cgatcgtatacacgaccggtgctcgatttagacgtctcatcaggggcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctccgctcactttcggcggagggaccaaggtgggatcaaacga

SEQ ID NO: 580232 - DNA, 494 bp, Homo sapiens; identical to SEQ ID NO: 534992
  misc_feature: HIJSMM301C5WHJ.9.1.A01.1.454.light.4.raw

SEQ ID NO: 580233 - DNA, 503 bp, Homo sapiens
  misc_feature: HIJSMM301DXY6O.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcgcgggggaccaagctgaccgtcctaggtcagcccaaggctgcccccg

SEQ ID NO: 580234 - DNA, 492 bp, Homo sapiens
  misc_feature: HIJSMM301ADHAK.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccgaggggaccgaaggtaggaagtcaagcgaactgtggctgcaccatctgtt

SEQ ID NO: 580235 - DNA, 521 bp, Homo sapiens; identical to SEQ ID NO: 578135
  misc_feature: HIJSMM301DB1H4.9.38.D05.1.454.light.4.raw

SEQ ID NO: 580236 - DNA, 488 bp, Homo sapiens
  misc_feature: HIJSMM301BS83V.48.35.D02.1.454.light.4.raw
agtatacatacacgaccggtgctcgatttagcacacgatagttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgca

SEQ ID NO: 580237 - DNA, 510 bp, Homo sapiens
  misc_feature: HIJSMM301CQ970.48.9.A09.1.454.light.4.raw
agtatacatacacgaccggtgctcgatttagcgagacgcgcagggcacgaccggtgctcgatttagacgcgatcgaagggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcacg

SEQ ID NO: 580238 - DNA, 503 bp, Homo sapiens
  misc_feature: HIJSMM301EIXKA.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaacccactgtcactctgttcccaccct

SEQ ID NO: 580239 - DNA, 506 bp, Homo sapiens; identical to SEQ ID NO: 534969
  misc_feature: HIJSMM301CDGSX.18.37.D04.1.454.light.4.raw
